US011286493B2

(12) United States Patent
Jacobsen et al.

(10) Patent No.: US 11,286,493 B2
(45) Date of Patent: Mar. 29, 2022

(54) METHODS AND COMPOSITIONS FOR TARGETING RNA POLYMERASES AND NON-CODING RNA BIOGENESIS TO SPECIFIC LOCI

(71) Applicant: The Regents of the University of California, Oakland, CA (US)

(72) Inventors: Steve E. Jacobsen, Agoura Hills, CA (US); Javier Gallego-Bartolomé, Beverly Hills, CA (US); Ashot Papikian, Glendale, CA (US)

(73) Assignee: The Regents of the University of California, Oakland, CA (US)

( * ) Notice: Subject to any disclaimer, the term of this patent is extended or adjusted under 35 U.S.C. 154(b) by 53 days.

(21) Appl. No.: 16/304,113

(22) PCT Filed: May 26, 2017

(86) PCT No.: PCT/US2017/034844
§ 371 (c)(1),
(2) Date: Nov. 21, 2018

(87) PCT Pub. No.: WO2017/205837
PCT Pub. Date: Nov. 30, 2017

(65) Prior Publication Data
US 2019/0203216 A1 Jul. 4, 2019

Related U.S. Application Data

(60) Provisional application No. 62/450,504, filed on Jan. 25, 2017, provisional application No. 62/342,814, filed on May 27, 2016.

(51) Int. Cl.
| | | |
|---|---|---|
| C12N 15/82 | (2006.01) | |
| C07K 16/00 | (2006.01) | |
| C12N 9/10 | (2006.01) | |
| C12N 9/12 | (2006.01) | |

(52) U.S. Cl.
CPC .......... *C12N 15/8216* (2013.01); *C07K 16/00* (2013.01); *C12N 9/1007* (2013.01); *C12N 9/1241* (2013.01); *C12N 15/8218* (2013.01); *C07K 2317/622* (2013.01); *C07K 2319/81* (2013.01); *C12N 2310/14* (2013.01); *C12N 2310/20* (2017.05); *C12N 2310/3521* (2013.01)

(58) Field of Classification Search
None
See application file for complete search history.

(56) References Cited

U.S. PATENT DOCUMENTS

| | | |
|---|---|---|
| 4,500,707 A | 2/1985 | Caruthers et al. |
| 4,683,195 A | 7/1987 | Mullis et al. |
| 4,945,050 A | 7/1990 | Sanford et al. |
| 5,268,463 A | 12/1993 | Jefferson |
| 5,399,680 A | 3/1995 | Zhu et al. |
| 5,436,327 A | 7/1995 | Southern et al. |
| 5,466,785 A | 11/1995 | Framond |
| 5,563,055 A | 10/1996 | Townsend et al. |
| 5,569,597 A | 10/1996 | Grimsley et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,641,876 A | 6/1997 | McElroy et al. |
| 5,683,439 A | 11/1997 | Jensen |
| 5,689,049 A | 11/1997 | Cigan et al. |
| 5,689,051 A | 11/1997 | Cigan et al. |
| 5,700,637 A | 12/1997 | Southern |
| 10,023,909 B2 * | 7/2018 | Dahl .................... C12Q 1/6846 |
| 2001/0010913 A1 | 8/2001 | Hillman et al. |
| 2002/0188103 A1 | 12/2002 | Bestor |
| 2004/0234997 A1 * | 11/2004 | Li ........................ C12N 9/1007 435/6.12 |
| 2014/0018241 A1 | 1/2014 | Sammons et al. |
| 2014/0068797 A1 | 3/2014 | Doudna et al. |
| 2015/0315252 A1 | 11/2015 | Farmer et al. |
| 2016/0017348 A1 | 1/2016 | Johnson et al. |
| 2017/0016017 A1 | 1/2017 | Fromm |

FOREIGN PATENT DOCUMENTS

| | | |
|---|---|---|
| WO | WO-1997011972 A1 | 4/1997 |
| WO | WO-2014134567 A1 | 9/2014 |
| WO | WO-2015048577 A2 | 4/2015 |
| WO | WO-2015138582 A1 | 9/2015 |
| WO | WO-2016011070 A2 | 1/2016 |
| WO | WO-2016063264 A1 | 4/2016 |
| WO | WO-2016103233 A2 | 6/2016 |

OTHER PUBLICATIONS

Zhong et al 2014 Cell 157:1050-1060). (Year: 2014).*
Adams et al., (2010). "PHENIX: a comprehensive Python-based system for macromolecular structure solution. Acta crystallographica Section D," Biological crystallography, 66:213-221.
Altschul et al., (1990). "Basic local alignment search tool," J. Mol. Biol., 215:403-410.
Altschul et al., (1997). "Gapped BLAST and PSI-BLAST: a new generation of protein database search programs," Nucleic Acids Res., 25:3389-402.
Anderson et al., (2010). "BglBricks: A flexible standard for biological part assembly," J Biol Eng., 4(1), 12 pages.
Arita et al., (2008). "Recognition of hemi-methylated DNA by the SRA protein UHRF1 by a base-flipping mechanism," Nature, 455:818-821.
Aufsatz et al., (2002). "RNA-directed DNA methylation in *Arabidopsis*," Proceedings of the National Academy of Sciences of the United States of America, 99(4):16499-16506.
Aufsatz et al., (2004). "The role of MET1 in RNA-directed de novo and maintenance methylation of CG dinucleotides," Plant Molecular Biology, 54:793-804.

(Continued)

*Primary Examiner* — Brent T Page
(74) *Attorney, Agent, or Firm* — Morrison & Foerster LLP

(57) ABSTRACT

The present disclosure relates to the use of recombinant proteins for inducing epigenetic modifications at specific loci, as well as to methods of using these recombinant proteins for reducing the expression of genes in plants.

9 Claims, 48 Drawing Sheets

Specification includes a Sequence Listing.

(56) References Cited

OTHER PUBLICATIONS

Avvakumov et al., (2008). "Structural basis for recognition of hemi-methylated DNA by the SRA domain of human UHRF1," Nature, 455:822-825.

Baazim, (2014). "Thesis: RNA-guided Transcriptional Regulation in Plants via dCas9 Chimeric Proteins." King Abdullah University of Science and Technology. Thuwal, Kingdom of Saudi Arabia. 74 pages.

Bassett et al., (2013). "Highly efficient targeted mutagenesis of *Drosophila* with the CRISPR-CAS9 system," Cell Rep, 4(1):220-228.

Belanger et al., (1991). "Molecular Basis for Allelic Polymorphism of the Maize Globulin-1 Gene," Genetics, 129:863-72.

Belhaj et al., (2013). "Plant genome editing made easy: targeted mutagenesis in model and crop plants using the CRISPR/Cas system," Plant methods, 9(1):39.

Berger et al., (1989). "Expression in transgenic plants of a viral gene product that mediates insect transmission of potyviruses," Proc. Natl. Acad. Sci. USA, 86:8402-8406.

Bernatavichute et al., (2008). "Genome-wide association of histone H3 lysine nine methylation with CHG DNA methylation in *Arabidopsis thaliana*," PloS one, 3(9):e3156, 11 pages.

Bian et al., (2011). "Sgf29 binds histone H3K4me2/3 and is required for SAGA complex recruitment and histone H3 acetylation," EMBO J, 30:2829-2842.

Binz et al., (2004). "High-affinity binders selected from designed ankyrin repeat protein libraries," Nat. Biotechnol., 22:575-582.

Black et al., (2012). "Histone lysine methylation dynamics: establishment, regulation, and biological impact," Molecular cell, 48:491-507.

Bogdanove et al., (2011). "TAL Effectors: Customizable Proteins for DNA Targeting," Science, 333:1843-6.

Bostick et al., (2007). "UHRF1 plays a role in maintaining DNA methylation in mammalian cells," Science, 317:1760-4.

Brzeski et al., (2003). "Deficient in DNA methylation 1 (DDM1) defines a novel family of chromatin-remodeling factors," The Journal of biological chemistry, 278:823-8.

Cao et al., (2002). "Role of the *Arabidopsis* DRM methyltransferases in de novo DNA methylation and gene silencing," Current biology, 12:1138-44.

Cao et al., (2003). "Role of the DRM and CMT3 methyltransferases in RNA-directed DNA methylation," Current Biology, 13:2212-7.

Cedar et al., (2009). "Linking DNA methylation and histone modification: patterns and paradigms," Nat Rev Genet, 10:295-304.

Chan et al., (2006). "Two-step recruitment of RNA-directed DNA methylation to tandem repeats," PLoS biology, 4:1923-33.

Chen et al., (2013). "Fusion protein linkers: Property, design and functionality," Advanced Drug Delivery Reviews 65(10):1357-1369, 32 pages.

Christensen et al., (1989). "Sequence analysis and transcriptional regulation by heat shock of polyubiquitin transcripts from maize," Plant Mol. Biol., 12:619-632.

Christensen et al., (1992). "Maize polyubiquitin genes: structure, thermal perturbation of expression and transcript splicing, and promoter activity following transfer to protoplasts by electroporation," Plant Mol. Biol., 18:675-89.

Cokus et al., (2008). "Shotgun bisulphite sequencing of the *Arabidopsis* genome reveals DNA methylation patterning," Nature, 452:215-219.

Cong et al., (2013). "Multiplex genome engineering using CRISPR/Cas systems," Science, 339(6121):819-823, 9 pages.

Conkling et al., (1990). "Isolation of transcriptionally regulated root-specific genes from tobacco," Plant Physiol., 9(3):1203-11.

Corpet et al., (1988). "Multiple sequence alignment with hierarchical clustering," Nucleic Acids Res., 16:10881-90.

Crawford et al., (2015). "Plant development. Genetic control of distal stem cell fate within root and embryonic meristems," Science, 347(6222):655-9.

Curtis et al., (2003). "A Gateway Cloning Vector Set for High-Throughput Functional Analysis of Genes in Planta," Plant Phys., 133:462-9.

Deltcheva et al., (2011). "CRISPR RNA maturation by trans-encoded small RNA and host factor RNase III," Nature, 471(7340):602-7, 19 pages.

Du et al., (2012). "Dual Binding of Chromomethylase Domains to H3K9me2-containing Nucleosomes Directs DNA Methylation in Plants," Cell, 151:167-180.

Dunoyer et al., (2010). "Small RNA duplexes function as mobile silencing signals between plant cells," Science, 328:912-6.

Ebbs et al., (2006). "Locus-specific control of DNA methylation by the *Arabidopsis* SUVHS histone methyltransferase," The Plant cell, 18:1166-76.

Eisen, (1998). "Phylogenomics: improving functional predictions for uncharacterized genes by evolutionary analysis," Genome Res., 8:163-167.

El-Shami et al., (2007). "Reiterated WG/GW motifs form functionally and evolutionarily conserved ARGONAUTE-binding platforms in RNAi-related components," Genes & development, 21:2539-2544.

Emsley et al., (2010). "Features and development of Coot," Acta crystallographica Section D, Biological crystallography, 66:486-501.

Esvelt et al., (2013). "Orthogonal Cas9 proteins for RNA-guided gene regulation and editing," Nature Methods, 10:1116-21.

Extended European Search Report received for European Patent Application No. 17803728.9, dated Oct. 1, 2019, 10 pages.

Feng et al., (2011). "Determining DNA Methylation Profiles Using Sequencing," Methods in Molecular Biology, 733:223-238.

Feng et al., (2013). "Efficient genome editing in plants using a CRISPR/Cas system," Cell Res, 23(10):1229-32.

Finnegan et al., (1993). "Isolation and identification by sequence homology of a putative cytosine methyltransferase from *Arabidopsis thaliana*," Nucleic acids research, 21:2383-88.

Friedland et al., (2013). "Heritable genome editing in C. elegans via a CRISPR-CAS9 system," Nat Methods, 10(8):741-3, 13 pages.

Fusaro et al., (2006). "RNA interference-inducing hairpin RNAs in plants act through the viral defence pathway," EMBO Reports, 7(11):1168-75.

Gilbert et al., (2013). "CRISPR-mediated modular RNA-guided regulation of transcription in eukaryotes," Cell, 154(2):442-451.

Gilbert et al., (2014). "Genome-Scale CRISPR-Mediated Control of Gene Repression and Activation," Cell, 159:647-661.

Gouet et al., (1999). "ESPript: analysis of multiple sequence alignments in PostScript," Bioinformatics, 15:305-308.

Greenberg et al., (2011). "Identification of genes required for de novo DNA methylation in *Arabidopsis*," Epigenetics, 6:344-354.

Guilinget al., (2014). "Fusion of catalytically inactive Cas9 to FokI nuclease improves the specificity of genome modification," Nature Biotechnology, 32(6):577-82, 17 pages.

Haag et al., (2011). "Multisubunit RNA polymerases IV and V: purveyors of non-coding RNA for plant gene silencing," Nat Rev Mol Cell Biol, 12:483-492.

Hashimoto et al., (2008). "The SRA domain of UHRF1 flips 5-methylcytosine out of the DNA helix," Nature, 455(7214):826-9, 10 pages.

Higgins et al., (1989). "Fast and sensitive multiple sequence alignments on a microcomputer," Comput Appl Biosci., 5:151-153.

Holm et al., (2010). "Dali server: conservation mapping in 3D," Nucleic Acids Res, 38:W545-9.

Hsu et al., (2013). "DNA targeting specificity of RNA-guided Cas9 nucleases," Nature Biotechnology, 31:827-32.

International Preliminary Report on Patentability received for PCT Patent Application No. PCT/US2017/034844, dated Dec. 6, 2018, 12 pages.

International Search Report and Written Opinion received for PCT Application No. PCT/US2017/034844, dated Oct. 24, 2017, 18 pages.

Jackson et al., (2002). "Control of CpNpG DNA methylation by the Kryptonite histone H3 methyltransferase," Nature, 416:556-60.

(56) References Cited

OTHER PUBLICATIONS

Jiang et al., (2013). "Demonstration of CRISPR-CAS9/sgRNA-mediated targeted gene modification in *Arabidopsis*, tobacco, sorghum and rice," Nucleic Acids Res, 41(20):e188, 12 pages.
Jinek et al., (2012). "A programmable dual-RNA-guided DNA endonuclease in adaptive bacterial immunity," Science, 337(6096):816-821.
Jinek et al., (2013). "RNA-programmed genome editing in human cells," eLife, 2(e00471), 9 pages.
Johnson et al., (2007). "The SRA methyl-cytosine-binding domain links DNA and histone methylation," Current biology, 17(4):379-84, 11 pages.
Johnson et al., (2008). "SRA-Domain Proteins Required for DRM2-Mediated De Novo DNA Methylation," PLoS Genet., 4(11):e1000280, 13 pages.
Johnson et al., (2014). "SRA- and SET-domain-containing proteins link RNA polymerase V occupancy to DNA methylation," Nature, 507:124-8.
Jones, (2012). "Functions of DNA methylation: islands, start sites, gene bodies and beyond," Nature reviews Genetics, 13:484-492.
Kakutani, (1997). "Genetic characterization of late-flowering traits induced by DNA hypomethylation mutation in *Arabidopsis thaliana*," The Plant journal, 12:1447-51.
Kang et al., (2008). "CRT1, an *Arabidopsis* ATPase that interacts with diverse resistance proteins and modulates disease resistance to turnip crinkle virus," Cell Host Microbe., 3(1):48-57.
Kang et al., (2008). "The involvement of the *Arabidopsis* CRT1 ATPase family in disease resistance protein-mediated signaling," Plant Signal Behav., 3(9):689-90.
Kang et al., (2010). "Endosome associated CRT1 functions early in resistance gene-mediated defense signaling in *Arabidopsis* and tobacco," Plant Cell, 22(3):918-36.
Kang et al., (2012). "CRT1 is a nuclear-translocated MORC endonuclease that participates in multiple levels of plant immunity," Nat Commun., 3, 11 pages.
Karlin et al., (1990). "Methods for assessing the statistical significance of molecular sequence features by using general scoring schemes," Proc. Natl. Acad. Sci. USA, 87:2264-2268.
Karlin et al., (1993). "Applications and statistics for multiple high-scoring segments in molecular sequences," Proc. Natl. Acad. Sci. USA, 90:5873-5877.
Kinoshita et al., (2007). "Control of FWA gene silencing in *Arabidopsis thaliana* by SINE-related direct repeats," The Plant journal, 49:38-45.
Kolb et al., (2005). "Site-directed genome modification: nucleic acid and protein modules for targeted integration and gene correction," Trends in biotechnology, 23(8):399-406.
Konermann et al., (2015). "Genome-scale transcriptional activation by an engineered CRISPR-CAS9 complex," Nature, 517(7536):583-8, 37 pages.
Kuhlmann et al., (2012). "Developmentally non-redundant SET domain proteins SUVH2 and SUVH9 are required for transcriptional gene silencing in *Arabidopsis thaliana*," Plant molecular biology, 79:623-33.
Larkin et al., (2007). "Clustal W and Clustal X version 2.0," Bioinformatics, 23:2947-8.
Laskowski, (1993). "PROCHECK: a program to check the stereochemical quality of protein structures," J Appl Cryst., 26:283-91.
Last et al., (1991). "pEmu: an improved promoter for gene expression in cereal cells," Theor. Appl. Genet., 81:581-8.
Law et al., (2010). "A protein complex required for polymerase V transcripts and RNA-directed DNA methylation in *Arabidopsis*," Current biology., 20(10):951-6, 13 pages.
Law et al., (2010). "Establishing, maintaining and modifying DNA methylation patterns in plants and animals," Nature reviews Genetics, 11:204-220, 31 pages.
Law et al., (2011). "SHH1, a Homeodomain Protein Required for DNA Methylation, As Well As RDR2, RDM4, and Chromatin Remodeling Factors, Associate with RNA Polymerase IV," PLoS Genet., 7(7):e1002195, 10 pages.

Lee et al., (2014). "Genetic Engineering and Chemical Conjugation of Potato Virus X," Methods Mol Biol., 1108:3-21, 20 pages.
Li et al., (2006). "An ARGONAUTE4-containing nuclear processing center colocalized with Cajal bodies in *Arabidopsis thaliana*," Cell, 126:93-106.
Li et al., (2013). "Multiplex and homologous recombination-mediated genome editing in *Arabidopsis* and Nicotiana benthamiana using guide RNA and CAS9," Nature biotechnology, 31(8):688-91, 8 pages.
Lindroth et al., (2001). "Requirement of CHROMOMETHYLASE3 for maintenance of CpXpG methylation," Science, 292:2077-80.
Lindroth et al., (2004). "Dual histone H3 methylation marks at lysines 9 and 27 required for interaction with CHROMOMETHYLASE3," The EMBO journal, 23:4286-96.
Lister et al., (2008). "Highly integrated single-base resolution maps of the epigenome in *Arabidopsis*," Cell, 133:523-36.
Liu et al., (2011). "An atypical component of RNA-directed DNA methylation machinery has both DNA methylation dependent and -independent roles in locus-specific transcriptional gene silencing," Cell Res, 21:1691-1700.
Liu et al., (2014). "The SET domain proteins SUVH2 and SUVH9 are required for Pol V occupancy at RNA-directed DNA methylation loci," PLoS Genet., 10(1):e1003948, 14 pages.
Luo et al., (2010). "Flexibility between the protease and helicase domains of the dengue virus NS3 protein conferred by the linker region and its functional implications," J Biol Chem., 285(24):18817-27.
Luque et al., (2000). "A constitutive region is responsible for nuclear targeting of 4.1 R modulation by alternative sequences results in differential intracellular localization," J Cell Sci, 113:2485-95.
Malagnac et al., (2002). "An *Arabidopsis* SET domain protein required for maintenance but not establishment of DNA methylation," The EMBO journal, 21:6842-52.
Mali et al., (2013). "Cas9 as a versatile tool for engineering biology," Nature Methods, 10(10):957-63, 16 pages.
Mali P, et al. (2013) CAS9 transcriptional activators for target specificity screening and paired nickases for cooperative genome engineering. Nature biotechnology 31(9):833-8, 17 pages.
Mao et al., (2013). "Application of the CRISPR-Cas system for efficient genome engineering in plants," Molecular plant, 6(6):2008-11.
Marton et al., (2010). "Nontransgenic Genome Modification in Plant Cells", Plant Physiology, 154:1079-1087.
Matsuo et al., (1994). "The CpG-specific methylase Sssl has topoisomerase activity in the presence of Mg2+," Nucleic Acids Res., 22(24):5354-9.
Matteucci et al., (1980). "The synthesis of oligodeoxyprimidines on a polymer support," Tetrahedron Lett, 21:719-22.
McCabe et al., (1988). "Stable transformation of soybean (*glycine max*) by particle acceleration," Biotechnology, 6:923-6.
McCormick et al., (1986). "Leaf disc transformation of cultivated tomato (*L. exculentum*) using Agrobacterium tumefaciens," Plant Cell Reports, 5:81-4.
McElroy et al., (1990). "Isolation of an efficient actin promterfor use in rice transformation," Plant Cell, 2:163-71.
Miao et al., (2013). "Targeted mutagenesis in rice using CRISPR-Cas system," Cell Res., 23:1233-6.
Miller et al., (1985). "Repetitive zinc-binding domains in the protein transcription factor IIIA from Xenopus oocytes," EMBO J., 4(6):1609-14.
Moissiard et al., (2012). "MORC family ATPases required for heterochromatin condensation and gene silencing#" Science, 336(6087):1448-51, 9 pages.
Moissiard et al., (2014). "Transcriptional gene silencing by *Arabidopsis* microrchidia homologues involves the formation of heteromers," Proc Natl Acad Sci USA, 111(20):7474-9.
Mosher et al., (2008). "PollVb influences RNA-directed DNA methylation independently of its role in siRNA biogenesis," Proc Natl Acad Sci USA, 105:3145-50.
Mukherjee et al., (2009). "A comprehensive classification and evolutionary analysis of plant homeobox genes," Mol Biol Evol., 26:2775-94.

(56) References Cited

OTHER PUBLICATIONS

Murray et al., (1989). "Codon usage in plant genes," Nucl. Acids Res., 17:477-98.
Myers et al., (1988). "Optimal alignments in linear space," Comput Appl Biosci., 4(1):11-7.
Nady et al., (2011). "Recognition of multivalent histone states associated with heterochromatin by UHRF1 protein," Journal of Biological Chemistry, 286:24300-11.
Needleman et al., (1970). "A general method applicable to the search for similarities in the amino acid sequence of two proteins," J. Mol. Biol., 48:443-53.
Odell et al., (1985). "Identification of DNA sequences required for activity of the cauliflower mosaic virus 35S promoter," Nature, 313:810-2.
Olovnikov et al., (2012). Small RNA in the nucleus: the RNA-chromatin ping-pong, Curr Opin Genet Dev., 22(2): 164-71, 15 pages.
Otwinowski et al., (1997). "Processing of X-ray diffraction data collected in oscillation mode," Methods Enzymol., 276:307-26.
Paszkowski et al., (1984). "Direct gene transfer to plants," EMBO J., 3:2717-22.
Pearson et al., (1988). "Improved tools for biological sequence comparison," Proc. Natl. Acad. Sci., 85:2444-48.
Pelissier et al., (2000). "A DNA target of 30 bp is sufficient for RNA-directed DNA methylation," RNA 6:55-65.
Pikaard et al., (2008). "Roles of RNA polymerase IV in gene silencing," Trends in plant science, 13(7):390-7, 15 pages.
Pontes et al., (2006). "The *Arabidopsis* chromatin-modifying nuclear siRNA pathway involves a nucleolar RNA processing center," Cell, 126:79-92.
Pontier et al., (2005). "Reinforcement of silencing at transposons and highly repeated sequences requires the concerted action of two distinct RNA polymerases IV in *Arabidopsis*," Genes & Development, 19:2030-40.
Puchta et al., (2013). "Synthetic nucleases for genome engineering in plants: prospects for a bright future," Plant journal, 78(5):727-41.
Qi et al., (2013) "Repurposing CRISPR as an RNA-Guided Platform for Sequence-Specific Control of Gene Expression," Cell, 152:1173-1183.
Rajakumara et al., (2011). "A dual flip-out mechanism for 5mC recognition by the *Arabidopsis* SUVHS SRA domain and its impact on DNA methylation and H3K9 dimethylation in vivo," Genes & development, 25:137-52.
Reiss et al., (1987). "Regions in the transit peptide of SSU essential for transport into chloroplasts." Mol. Gen. Genet., 209(1):116-121.
Riggs et al., (1986). "Stable transformation of tobacco by electroporation: evidence for plasmid concatenation," Proc. Natl. Acad Sci. USA, 83:5602-06.
Rincon-Arano et al., (2012). "UpSET Recruits HDAC Complexes and Restricts Chromatin Accessibility and Acetylation at Promoter Regions," Cell, 151:1214-28.
Rogers et al., (1987). "Improved Vectors for Plant Transformation: Expression Cassette Vectors and New Selectable Markers," Meth. in Enzymol., 153:253-77.
Saitou et al., (1987). "The neighbor-joining method: a new method for reconstructing phylogenetic trees," Mol. Biol. & Evo., 4:406-25.
Segal et al., (2003). "Module networks: identifying regulatory modules and their condition-specific regulators from gene expression data." Nat Genet, 34(2):1-48.
Settles et al., (1998). "Old and new pathways of protein export in chloroplasts and bacteris," Trends Cell Biol, 12:494-501.
Shan Q, et al. (2013). "Targeted genome modification of crop plants using a CRISPR-Cas system," Nature biotechnology, 31(8):686-8.
Shen et al., (2008). "Engineering peptide linkers for scFv immunosensors," Anal Chem., 80(6):1-22.
Siddique et al., (2013). "Targeted Methylation and Gene Silencing of VEGF-A in Human Cells by Using a Designed Dnmt3a-Dnmt3L Single-Chain Fusion Protein with Increased DNA Methylation Activity," Journal of Molecular Biology, 425(3):479-491.

Smith et al., (1981). "Comparison of biosequences," Adv. Appl. Math., 2:482-9.
Smith, E. et al., (2010). "The chromatin signaling pathway: diverse mechanisms of recruitment of histone-modifying enzymes and varied biological outcomes," Molecular cell, 40:689-701.
Soppe et al., (2000). "The late flowering phenotype of fwa mutants is caused by gain-of-function epigenetic alleles of a homeodomain gene," Molecular cell, 6:791-802.
Springer et al., (2003). "Comparative analysis of SET domain proteins in maize and *Arabidopsis* reveals multiple duplications preceding the divergence of monocots and dicots," Plant physiology, 132:907-25.
Stroud et al., (2013). "Comprehensive analysis of silencing mutants reveals complex Yegulation of the *Arabidopsis* methylome," Cell, 152:352-64.
Stroud et al., (2013). "Plants regenerated from tissue culture contain stable epigenome changes in rice," eLife, 2:e00354, 14 pages.
Sugano et al., (2014). "CRISPR-CAS9 Mediated Targeted Mutagenesis in the Liverwort *Marchantia polymorpha* L.," Plant & cell physiology, 55(3):475-81.
Swiech et al. (2015). "In vivo interrogation of gene function in the mammalian brain using CRISPR-CAS9," Nature Biotechnology, 33(1): 102-6, 22 pages.
Tamura et al., (2007). "MEGA4: Molecular Evolutionary Genetics Analysis (MEGA) software version 4.0," Mol. Biol Evol., 24(8):1596-9.
Tanenbaum et al., (2014). "A Protein-Tagging System for Signal Amplification in Gene Expression and Fluorescence Imaging," Cell 159:635-46.
Taverna et al., (2007). "How chromatin-binding modules interpret histone modifications: lessons from professional pocket pickers," Nat Struct Mol Biol, 14(11):1025-40, 40 pages.
Thompson et al., (1994). "Clustal W: improving the sensitivity of progressive multiple sequence alignment through sequence weighting, position-specific gap penalties and weight matrix choice," Nucleic Acids Res., 22: 4673-80.
Upadhyay et al., (2013). "RNA-Guided Genome Editing for Target Gene Mutations in Wheat.," G3 (Bethesda), 3(12):2233-8.
Van der Oost et al., (2014). "Unravelling the structural and mechanistic basis of CRISPR-Cas systems," Nature Reviews, 12(7):479-92, 30 pages.
Velten et al., (1984). "Isolation of a dual plant promoter fragment from the Ti plasmid of Agrobacterium tumefaciens," EMBO J., 3(12):2723-2730.
Walker et al., (1987). "DNA sequences required for anaerobic expression of the maize alcohol dehydrogenase 1 gene," Proc. Natl. Acad. Sci. USA, 84:6624-8.
Wang et al., (1992). "Characterization of cis-Acting elements regulating transcription from the promoter of a constitutively active rice actin gene," Molecular and Cellular Biology, 12(8):3399-3406.
Wierzbicki et al., (2008). "Noncoding transcription by RNA polymerase Pol IVb/Pol V mediates transcriptional silencing of overlapping and adjacent genes," Cell, 135:635-48.
Wierzbicki et al., (2009). "RNA polymerase V transcription guides ARGONAUTE4 to chromatin," Nature genetics, 41(5):630-4, 14 pages.
Woo et al., (2008). "Three SRA-domain methylcytosine-binding proteins cooperate to maintain global CpG methylation and epigenetic silencing in *Arabidopsis*," PLoS genetics, 4(8):e1000156, 13 pages.
Wu et al., (2010). "Structural biology of human H3K9 methyltransferases," PLoS one, 5(1):e8570, 10 pages.
Wu et al., (2014). "Genome-wide binding of the CRISPR endonuclease Cas9 in mammalian cells," Nature Biotechnology, 32(7):670-6.
Xie et al., (2004). "Genetic and functional diversification of small RNA pathways in plants," PLoS Biol, 2(5):0642-52.
Xie et al., (2013). "RNA-guided genome editing in plants using a CRISPR-Cas system," Molecular plant, 6(6):1975-1983.
Xie et al., (2015). "Boosting CRISPR/Cas9 multiplex editing capability with the endogenous tRNA-processing system," Proc Natl Acad Sci USA, 112(11):3570-5.

(56) References Cited

OTHER PUBLICATIONS

Yang et al., (2013). "One-step generation of mice carrying reporter and conditional alleles by CRISPR/Cas-mediated genome engineering," Cell, 154(6):1370-9.
Zalatan et al., (2015). "Engineering Complex Synthetic Transcriptional Programs with CRISPR RNA Scaffolds," Cell, 160:339-50.
Zhang et al., (2002). "Structure of the Neurospora SET domain protein DIM-5, a histone H3 lysine methyltransferase," Cell, 111:117-27.
Zhang et al., (2003). "Structural basis for the product specificity of histone lysine methyltransferases," Molecular cell, 12:177-185.
Zhang et al., (2006). "Genome-wide high-resolution mapping and functional analysis of DNA methylation in *arabidopsis*," Cell, 126:1189-1201.
Zhang et al., (2007). "Role of RNA polymerase IV in plant small RNA metabolism," Proc Natl Acad Sci USA, 104:4536-41.
Zhang et al., (2009). "Genome-wide analysis of mono-, di-and trimethylation of histone H3 lysine 4 in *Arabidopsis thaliana*," Genome Biol., 10:R62.1-R62.14.
Zhong et al., (2012). "DDR complex facilitates global association of RNA polymerase V to promoters and evolutionarily young transposons," Nat Struct Mol Biol, 19(9):870-5.
Zilberman et al., (2003). "ARGONAUTE4 control of locus-specific siRNA accumulation and DNA and histone methylation," Science, 299:716-9.
Zilberman et al., (2004). "Role of *Arabidopsis* ARGONAUTE4 in RNA-directed DNA methylation triggered by inverted repeats," Current Biol., 14:1214-20.
Zuckerkandl et al., (1965). "Evolutionary divergence and convergence in proteins," Evolving Genes and Proteins, pp. 97-166.

* cited by examiner

```
AGO4    MDSTNGNGADLESANGANGSGVTEALPPPPPVIPPNVEPVRVKTELAERKGPVRVPMAR-  59
AGO9    MDSDEPKGS---------------GLPPPPPFVPANLVP-----EVEPVKKNILLPMARP  40
AGO6    METS--------------------SSLPLSPISIEP---------EQPSBRDYDITTR   29
        *::                      .. *. * .: *                   ::

AGO4    KGFGTRGQKIPLLTKBFKVDVANLQGBFFBYSVALFYDDGRPVEQKGVGRRILDKVEQTY 119
AGO9    RGSGSKGQRIPLLTKBFGVRFNKPSGYFFBYSVAINYEDGRPVEAKGIGRRILDKVQETY 100
AGO6    RGVGTTGNPIELCTKBFNVSVRQPDVVFYQYTVSITTENGDAVDGTGISRKLMDQLFKTY  89
        :* *: *:  * * **** *.. : .  *::*:*::  ::* .*: .*:.**::*:: :**

AGO4    BSDLDGRKFAYDGEKTLFTYGALPSNKMDFSVVLEEVSATRANGNGSPNGKESPSDGDRK 179
AGO9    QSDLGAKYFAYDGEKTLFTVGALPSNKLDFSVVLEEIPSSRNEAGNDTN------DADRK 154
AGO6    SSDLDGKRLAYDGEKTLYTVGPLPQKEFDFLVIVEGSFSKRDCGVSDGG-----SSSGTCK 145
        ***..* :*********:* *.**.*::**  *:::*  :.*  . ...   .. *

AGO4    RLRRPNRSKNFRVEISYAAEIPLQALANAMRGQES--ENSQEAIRVLDEIILRQBAARQGC 237
AGO9    RSRRPNQTKKFMVEISYAAKIPMQAIASALQGKET--ENLQDALRVLDEIILRQSAARQGC 212
AGO6    RSKRSFLPRSYKVQIHYAAEIPLKTVLGTQRGAYTPDKSAQDALRVLDIVLRQQAAERGC  205
        * :*.  .:.: *:* ***:**:::  .: :*   :   :. *:*:*****:*** **.:**

AGO4    LLVRQSFFENDPTKCEPVGGNILGCRGFBSSFRTTQGGMSLNMDVTTTMIIRPGPVVDFL 297
AGO9    LLVRQSFFENDVKNFVPIGGGVSGCRGFBSSFRTTQGGLSLNIDTSTTMIVQPGPVVDFL 272
AGO6    LLVRQAFFESDGEPMK-VGGGVIGIRGLBSSFRPTBGGLSLNIDVSTTMILEPGPVIEFL 264
        *****:***.*     :**.:  * **:*****.*:**;***:*.:****::****::**

AGO4    IANQWARDPYSIDWSRAKRTLKNLRVKVSPSGQEFKRITGLSDKPCREQTFELKKRNPKEN 357
AGO9    LANQNKKDPYGMDWNKARRVLKNLRVQITESNREYKISGLSEBSCKDQLFTWRK---PNDK 330
AGO6    RAKQSVETPRQIDWIRAAKMLKBMRVKATBRNMEFKIIGLSSKPCNQQLFSMKIK--DGE  322
        ***. .  * :** ** : **::**:*  :  .*:**  ***. :.*. :*  *   : :

AGO4    GEFEFTEVTVADYFRDTRBIDLQYSADLPCINVGKPKRPTYIPLELCALVPLQRYEKALT 417
AGO9    GEFEEVEITVLNYYKE-RNIEVRYSGDFPCINVGKPKRPTYFPIEFCNLVSLQRYEKSLT 389
AGO6    REVPIREITVYDYFKQ-TYTEPISSAYFPCLDVGKPDRPNYLPLEFCNLVSLQRYEKPLS 381
        *.   *:**  *:*::: *    : .*.  :**:****.**.*:*:*:* **.******.*:

AGO4    TFQRSALVEKSRQKPQERMTVLSKALKVSNYDAEPLLRSCGISISSNFTQVEGRVLPAPK 477
AGO9    NFQRAALVEKSRQKPPERMASLTKGLKDSNYNADPVLQDSGVSIITKFTQVEGRILPTPM 449
AGO6    GRQRVLLVESSRQKPLERIKTLNDAMBTYCYDKDPFLAGCGISIEKEMTQVEGRVLKPPM 441
        ** *** **** **: *...::   *: :*.* ..*:** .:*:*****:* .*

AGO4    LKMGCGSETFPRNGRWNFNNKEFVEPTKIQRWVVVNFSARCNVRQVVDDLIKIGGSKGIE 537
AGO9    LKVGKGENLSPIKGRWNFMRKTLAEPETVFRWAVVNFSARCDTNFLIRDLIKCGREKGIN 509
AGO6    LKFGKNEDFQPCNGRWNFNNKMLLEPRAIKSWAIVNFSFPCDSSHISRELISCGMREGIE 501
        **.*  ..:  * :*:***  .*  :  **  :  *.:****  *:  :  :**. *  ***:

AGO4    IASPFQ-VFEEGNQFRRAPPMIRVEKMFKDIQSRLPGVPQFILCVLPDRKKSDLYGPWRK 596
AGO9    VEPPFKDVINENPQFRNAPATVRVEKMFEQIKSRLPKPPLFLLCILAERKKSDVYGPWKK 569
AGO6    IDRPFA-LVEEDPQYKKAGPVERVERMIAFMKLRFPDEPHEFILCELPERKTSDIYGPWKK 560
        :  **  :,:*. *::*.* ,    ***:*: ::  *:*   * *:**:*.::*.**:*****

AGO4    KNLTEFGIVTQCMAPTRQPNDQYLTNLLLRINAKLGGLNSMLSVERTPAFTVISKVPTII 656
AGO9    KNLVDLGIVTQCIAPTR-LNDQYLTNVLLRINARLGGLNSLLAMERSPAMPKVTQVPTII 628
AGO6    ICLTEEGIBTQCICPIK-ISDQYLTNVLLRINSRLGGINSLLGIEYSYNIPLINKIPTLI 619
        *..: **  ***:.* :   .********:*****:**:*.:*   :. :.::**:*

AGO4    LGMDVSBGSPGQSDVPSIAAVVGSRENPLISKYRASVRTQPFSKAEMIESLVRKNGIE--- 713
AGO9    VGMDVSBGSPGQSDIPFSIAAVVGSRQWPLISKYRACVRTQSRKMEMIDNLFRKPVKGK--- 685
AGO6    LGMDVSBGSPPGRADVPSVAAVVGSRCWPLISRYRAAVRTQSPRLEMIDSLFQPIENTERG 679
        :********.**::*:**;****.*:  *****:*;*.****. :  ***:.*.:

AGO4    DDGIEKELLVDFYTSSNKRKPEBIIIFRDGVSESQFKQVLNIELDQIIEACKLLDANWKP 773
```

FIG. 1A

```
AGO9   DEGMFRELLLDFYYSSENRKPEBIIIFRDGVSESQFKQVLNIELDQMMQACKFLDDTWHP  745
AGO6   DNGIMNELFVEFYRTSRARKPRQIIIFRDGVSESQFEQVLRIEVDQIIRAYQRLGESDVP  739
       *:*:;.**::;** ;*. ***::************:***;**;**:;;* : *. . *

AGO4   RFLLLVAQKNHBTKFFQPTSPENVPPGTIIDNKICHPKNEDFYLCAHAGMIGTTRPTHYB  833
AGO9   RFTVIVAQKNHBTKFFQSRGPDNVPPGTIIDSQICHPRNFDFYLCAHAGMIGTTRPTHYB  805
AGO6   RFTVIVAQKNHBTKLFQARGPENVPAGTVVDTKIVHPTNYDFYMCAHAGKIGTSRPAHYB  799
       ** ;:*********:**. .*:***.**:;*..:* ** * ***:***** ***:**:***

AGO4   VLYDEIGFSADELQELVHSLSYVYQRSTSAISVVAPICYAHLAAAQLGTFMRFEDQGETS  893
AGO9   VLYDEIGFATDDLQELVHSLSYVYQRSTTAISVVAPVCYAHLAAAQMGTVMKYEELSETS  865
AGO6   VLLDEIGFSPDDLQKLIHSLSYVNQRSTTATSIVAPVRYAHLAAAQVAQFTKFEGISEDG  859
       ** *****;.*;**;*;****** ****;* *;***; *******;. . *;* ** .

AGO4   SSHGGITAPGPISVAQLPRLKDNVAKSMFFC  924
AGO9   SSHGGITPPGAVPVPPMPQLEHNVSTSMFFC  896
AGO6   K-------------VPELPRLEENVEGMFFC  878
       .               *. :*:*::** .****
```

FIG. 1B

```
HDA1    --MDTGGNSLASGPDGVKRKVCYFYDPEVGNYYYGQGHPMKPHRIRMTHALLAHYGLLQH  58
HDA9    --MRS------------KDKISYFYDGDVGSVYFGPNHPMKPHRLCMTHHLILAYGLHSK  46
HDA6    MEADESGISLPSGPDGRKRRVSYFYEPTIGDYYYGQGHPMKPHRIRMAHSLIIHYHLHRR  60
HDA7    ---------MASLADGGKRRVSYFYEPMIGDYYYGVNQPTKPQRIRVTHNLILSYNLHRH  51
                  *  ::.***:    :*.  *:*  .:* **:*: ::* *:   * *   :

HDA1    MQVLKPFPARDRDLCRFHADDYVSFLRSITPETQQD----QIRQLKRFNVGEDC--PVFD  112
HDA9    MEVYRPHKAYPIEMAQFHSPDYVEFLQRINPENQNL----FPNEMARYNLGEDC--PVFE  100
HDA6    LEISRPSLADASDIGRFHSPEYVDFLASVSPESMGD--PSAARNLRRFNVGEDC--PVFD  116
HDA7    MEINHPDLADASDFEKFHSLEYINFLKSVTPETVTDPHPSVSENLKRFNVDVDWDGPVFH  111
        ::: :*   *   :: :**: :*:.**  :.**.       .:: *:*:.. *   ***.

HDA1    GLYSFCQTYAGGSVGGSVKLNHGLCDIAINWAGGLHHAKKCEASGFCYVNDIVLAILELL  172
HDA9    DLFEFCQLYAGGTIDAARRLNNKLCDIAINWAGGLHHAKKCDASGFCYINDLVLGILELL  160
HDA6    GLFDFCRASAGGSIGAAVKLNRQDADIAINWGGGLHHAKKSEASGFCYVNDIVLGILELL  176
HDA7    NLFDYCRAYAGGSISAAAKLNRQEADIAINWAGGMHHVKKDKASGFGYVNDVVLAILELL  171
        .*:.:*:  ***::..:  :**.  .******.**:**.**  .**** *:**:**.*****

HDA1    KQHERVLYVDIDIHHGDGVEEAFYATDRVMTVSFHKFGD-YFPGTGHIQDIGYGSGKYYS  231
HDA9    KHHPRVLYIDIDVHHGDGVEEAFYFTDRVMTVSFHKFGDKFFPGTGDVKEIGEREGKFYA  220
HDA6    KMFKRVLYIDIDVHHGDGVEEAFYTTDRVMTVSFHKFGDFFPG-TGHIRDVGAEKGKYYA  235
HDA7    KSFKRVLYIEIGFPHGDEVEEAFKDTRVMTVSFHKVGD-----TGDISDYGEGKGQYYS  226
        *  .  ****:*:*..  *** *****  **********:.**         **.:  :  *  .*::*:

HDA1    LNVPLDDGIDDESYHLLFKPIMGKVMEIFRPGAVVLQCGADSLSGDRLGCFNLSIKGHAE  291
HDA9    INVPLKDGIDDSSFNRLFRTIISKVVEIYQPGAIVLQCGADSLARDRLGCFNLSIDGHAE  280
HDA6    LNVPLNDGMDDESLFRPLIQKVMEVYQPEAVVLQCGADSLSGDRLGCFNLSVKGHAD  295
HDA7    LNAPLKDGLDDFSLRGLFIPVIHRAMEIYEPEVIVLQCGADSLAGDPFGTFNLSIKGHGD  286
        :*.**.**:**  *  .  **  .::  :.:*::.*   .:**********:   * :*   ****:.**.:

HDA1    CVKFMRSFNVPLLLLGGGGYTIRNVARCWCYETGVALGVEVEDKMPEHEYYEYFGPDYTL  351
HDA9    CVKFVKKFNLPLLVTGGGGYTKENVARCWTVETGILLDTELPNEIPENDYIKYFAPDFSL  340
HDA6    CLRFLRSYNVPLMVLGGGGYTIRNVARCWCYETAVAVGVEPDNKLPYNEYFEYFGPDYTL  355
HDA7    CLQYVRSFNVPLMILGGGGYTLPNVARCWCYETAIAVGEQLDNDLPGNDYMKYFRPDYKL  346
        *::::::.:*:**:: ******   ******  **.:   :. :    :..:* ::*  :** **:.*

HDA1    HVAPSNMENKNSRQMLEEIRNDLLHNLSKLQHAPSVPFQERPPDTETPEVDEDQEDGDKR  411
HDA9    KIPGGHIENLNTKSYISSIKVQILENLRYIQHAPSVQMQEVPPDFYIPDFDEDEQNPDVR  400
HDA6    HVDPSPMENLNTPKDMERIRNTLLEQLSGLIHAPSVQFQHTPP--VNRVLDEPEDDMETR  413
HDA7    HILPTNRQNLNTRLDIITMRETLLAQLSLVMHAPSVPFQDTPS--SSQATEAAEVDMEKR  404
        ::       :* *:    :  ::  :* :*  :  ***** :*.  *.       :   : : : *

HDA1    WDPDSDMDVDDDRKPIPSRVKREAVEPDTKDKDGLKGIMERGKGCEVEVDESGSTKVTGV  471
HDA9    AD-------------QRSRDKQIQRDDEYFDGDN------------DNDAS-------   426
HDA6    PK-------------PRIWSGTATYESDSDDDDKPLHGYSCRGGATTDRDSTGEDEMD   458
HDA7    ND-------------PRI--------------------------------------   409
                                *

HDA1    NPVGVEEASVKMEEEGTNKGGAEQAFPPKT  501
HDA9    ------------------------------
HDA6    DDNPEPDVNPPSS-----------------  471
HDA7    ------------------------------
```

FIG. 2

```
JMJ18   ------------------------------------------------MENPPLESEIKEDM  14
JMJ15   -----------------------------------------------MEPFSAAQNKEDK  13
JMJ14   -----------------------------------------------MDQLASLAESVAM  13
PKDM7D  MGTELMRICVKEDSDDLPSVPPGFESYATFTLKRVVPATTSDKAKTPAIESVSATEQAKM  60
                                                        .

JMJ18   SLKNHPPDK-------------------DKDKDTIMEQPS----SPRHRK------  41
JMJ15   DTSVEPPRRR------------------CHRKNKGTNVEPPS----SPYHPK------  43
JMJ14   EEDSEKQ---------------------SIKGESSLEPDS----TPSSPK------  38
PKDM7D  EVESDEAKAABALRRRPWINHSGCDDDGDCAANNDNAASQNPDQNCDVKPALPKGVVRGC  120
        ...                           :   .    .*    *

JMJ18   --------VVARWLPDEAQRPIINDAPVFTPSLEEFVDPLAYIEKIRPLAEPYGICRIIP  93
JMJ15   --------VLARWDPANEKRPDIGEAPVFHPTSEEFFEDTLAYIEKIRPLAESFGICRIVP  95
JMJ14   --------ITARWNPSEACRPLVDDAPIFYPTNEDFDDPLGYIEKLRSKAESYGICRIVP  90
PKDM7D  EECKDCQKVTARWHPDEARRPDLEDAPVFYPSEEEFEDTLNYIARIRPEAEKYGICRIVP  180
                : *** *  :  ** : :**:* *: *:*  *.* ** *:*. ** :*****:*

JMJ18   PSTWKPPCRLKEKSIWEQTKFPTRIQTVDLLQNREPMKKK---PKSRKRKRRRNSRMGSS  150
JMJ15   PSNWSPPCRLKGDSIWKNKNFPTRVQFVDLLQNRGPVKKKT--PKGRKRKRGKYSRTVAP  153
JMJ14   PVAWRPPCPLKEKKIWENSKFPTRIQFIDLLQNREPIKKS---TKTKKRKRBRISKIGYT  147
PKDM7D  PPSWKPPCPLREKQVWEGSKFTTRVQRVDKLQNRSSMKKISKLPNQMRKKKRKCMRKGMD  240
        *   * *** **  ..:*;  .:*.**:* :* ****  .:**    .:  ::*: :  :

JMJ18   KRRSGS--SPAESTSSPEAEEKFGFNSGSDFTLDEFEKYALHFKDSYFEKKDSGGDIV---  206
JMJ15   KKRNGSVSKSVSTPKATEEENFGFESGPEFTLKEFEKYAQDFKDSYFERKDNVGD-----  208
JMJ14   RRKRDSGCDTASSGSSDSEGKFGFQTGPDFTLEEFQKYDEYFKECYFQSEDHPGSKASEN  207
PKDM7D  SVTNGMGDPCSASTGMNELETFGFEPGPGFTLKDFQKYADEFKAQYFKKSETSTDDKCRV  300
         .    ::      .***:.*. ***..*:** ** **: .:    .

JMJ18   -----KWTPSVDDIEGEYWRIVEQPTDEVEVYYGADLENGVLGSSGFYKRAEKFTG-SDME  260
JMJ15   --------PSVEEIEGEYWRIIEKETNEVKVLYGTDLENPILGSGFSKGVKIPTRRNDMD  260
JMJ14   K----KFKPKVRDLEGEYWRIVEQATDEVEVYYGADLETKKFGSGFPK-YKPGYPISEAD  262
PKDM7D  DNSIDCWEPALEDVEGEYWRIVDKATEEIEVLYGADLETGVFGSGFPKISSSHNASSSED  360
             *  :.::*******::: *:*:** **:***.   :***** *    .. :

JMJ18   QYTLSGWNLNNLPRLPGSVLSFEDCDISGVLVPWLYVGMCFSSFCWHVEDHHLYSLNYHH  320
JMJ15   KYISSGWNLNNLARLQGSLLSFEDCEISGVQVPWLYVGMCFSTFCWHVEDNHLYSLNYEH  320
JMJ14   QYSQCGWNLNNLSRLPGSVLAFESCDISGVIVPWLYVGMCFSTFCWHVEDHHLYSMNYLH  322
PKDM7D  KYARSGWNLNNFPRLPGSLLKYEGSDISGVLVPWLYIGMCFSSFCWHVEDHHLYSLNYMH  420
        :*  .******:.** **:*  :*..:**** *****;*****;*******:****** *

JMJ18   FGEPKVWYGVPGSNATALEKAMRKHLPDLFEEQPDLLHGLVTQFSPSILKDEGVQAYRVV  380
JMJ15   FGEPKVWYGVPGSHATGLEKAMRKHLPDLFDEQPDLLHELVTQFSPTILKNEGVPVYRAV  380
JMJ14   TGDPKVWYGIPGNHAESFENVMKKRLPDLFEEQPDLLHQLVTQLSPRILKEEGVPVYRAV  382
PKDM7D  WGAPRLWYGVGGKDAVKLEFAMRKHLPDLFEEQPDLLHKLVTQLSPSKLKTAGVPVHRCV  480
         *  **:***:  *..*  :*:.*:*;*****:******  ****:**  **   **  ..:* *

JMJ18   QNSGEYVLTFPRAYHAGFNCGFNCAEAVNVAPVDWLAHGQNAVELYSKETRKTSLSHDKL  440
JMJ15   QNAGEYVLTFPRAYHSGFNCGFNCAEAVNVAPVDWLAHGQNAVEIYSQETRKTSLSHDKI  440
JMJ14   QRSGEFILTFPRAYHSGFNCGFNCAEAVNVAPVDWLVHGQNAVEGYSKQRRKSSLSHDKL  442
PKDM7D  QHAGEFVLTFPRAYHAGFNSGFNCAEAVNVAPVDWLPHGQIAIELYCQQGRKTSISHDKL  540
        *.:**:**:***.****.***;*** *********  ***  *;*  *.:: **:*;*****:

JMJ18   LLGAAYEAVKALWELSASEGKENTTNLRWKSFCGKNGTLTNAIQARLQMEEGRITALGRD  500
JMJ15   LLGAAFEAVKSL-----SAHGEDNTKRFSWKRFCGKDGIITKAIEARLRMEEKRIEALG-N  495
JMJ14   LLGAAMEATYCLWELSLSKKK-TPVIARWKRVCSEDGLLTKAVKKRVQMEEERLNHLQ-D  500
PKDM7D  LLGAAREVVKADWELNLLRKN-TVDNLRWKAFSARKDGILAKTLKARIDMERTRREFLC-N  598
        *****  *...    .  :    **  ...::* :::::::  *: **. *   * :

JMJ18   SSSLKRMEKDFDSNCERECFSCFYDLHLSASGCK--CSPEEYACLKHADDLCSCDVKDGF  558
```

FIG. 3A

```
JMJ15    GFSLVKMDKDFDSNCERECISCFSDLHLSATGCKNCSSLEEYGCTKH--DICSCEGKDRF  553
JMJ14    GFSLRKMEGDFDNKRERECFLCFYDLHMSASSCK--CSPNRFACLIHAKDLCSCESKDRY  558
PKDM7D   SSLALKMHSNFDATNERECCICFFDLHLSAAGCR--CSPEKYSCLTHVKELCSCPWVTKY  656
                . **. :**  . ****   ** ***:**:.*:     .*   :.:.*   *    :;***     :

JMJ18    ILLRYTMDELSSLVRALEGESDDLKIWASKVLG----------------------------  591
JMJ15    IFLRYTIDELSSLVRALEGESDDLRAWLSKVM----------------------------  585
JMJ14    ILIRHTLDELWALVRALEGDLDAIDLWASKCRDQYPSQHPRAREYAY-------------  605
PKDM7D   FLFRYDIDELNVLVEAVEGKLSSVYRWARQDLGLALSTDVSGSKMEIDEEGKVHKDPTPQ  716
                :::*:   :***    **.*:**. . :      *    :

JMJ18    -------------------IEHSDEDQTKTSSVISEEKKLK------------------  613
JMJ15    -------------------EGCSETQRGESSGIIVKEKQVQ------------------  607
JMJ14    ----------LKSAPCIKSRGSSKVQQREQNNLQLVSERLQSD----------------  638
PKDM7D   TTALSGKDLQLKVTSKEVSKELEKTSKLSHVNLLLKEKEEQITSSHCMKPVKEETVCDSS  776
                                  ..  .:   .   .:       .:.  :

JMJ18    ------------------------------------EGSFDLNID---LEMDYQE-  629
JMJ15    ------------------------------------EECFDLNG-----ECNKSS-  621
JMJ14    ----------------------------LTSNKEVQLKQDGSDVNREHGHESERNHVH-  668
PKDM7D   DPNVSACQPSEGGIICMTAVKSASGKKNSQSLPNDVILLSDDEYDIPRKRGSVRRDAISS  836
                                         :      *:         . :

JMJ18    ------------------------------------------------------------
JMJ15    ------------------------------------------------------------
JMJ14    ------------------------------------------------------------
PKDM7D   GKRLEIRERPTHVLALEASAKIAAPICQREGDSLRDTRNTISLPTNDQKTMRRDVPSSTS  896

JMJ18    -------------DVKEEASTSGG------------------------------  640
JMJ15    -------------EICEDASIMD-------------------------------  631
JMJ14    -------------GITDKSAVTDVKLGVGGKFDEKKIS-------VESQNPHSVSDVGCS  708
PKDM7D   HAEVNAEATGLTQDICNRMATNSHGGGKPTSCKSRNSGGLAIVDVVDGTRSSSGTPSCSQ  956
                              :   :   :     .  .

JMJ18    ---------------ELTASENLGVSVEPINLGFLIFGKLWCNKYAIFPKGFRSRVKFYNV  686
JMJ15    -------------------LAAYH-----VEPINLGFLVVGKLWCNKHAIFPKGFKSRVKFYNV  671
JMJ14    ELAKKVDGCLGGKDQNAATNRLSLSVELLSSGSLVVKKLWCSRQAIYPKGFKSRVKFLSV  768
PKDM7D   NNSPDRFIRQKGPRIAKVVRRINCNVEPLSYGCVLSGKSWCSRRAIFPKGFRSRVKYINI  1016
                            . .  :. * ::    * **.:  **;****:****:  .:

JMJ18    LDPTRMSNYISEVLDAGIMGPLFRVTLEESPDESFFNVSAQQCWEMVMRRVKDTST--SL  744
JMJ15    QDPMRISYYVSEIVDAGLLGPLFKVTLEESQDESFSYASPQKCWEMVLLRVKEEIMRRSN  731
JMJ14    LDPTNLTNYISEVLDAGLLGPLFRVSVEDYPTENFSNVSAEKCWQMVTQRLKLEIIKKCD  828
PKDM7D   LDPTNMCFYISEILDAGRNSPLFMVYLESNPSEVFVHMSPTRCWEMVRERVNQEITKQHK  1076
                ** .:  *:**::***  .*** * :*.   * *  *. :**:**   *::

JMJ18    GLPI----LPQFESINGLQMFGFLSPSIVQAIEALDPNHRLVEYWNHK-----------  788
JMJ15    QKQD----VHMLESIDGLRMFGFRSPFIVQATEALDPNHGQVEYWNHK-----------  775
JMJ14    QPVSSLTSLQPLESINGLEMFGFLSPHVIKVVEALDPKHQLEEYWNQKAV-----KLFGA  883
PKDM7D   AGKSDLPPLQPSGSPDGFEMFGYSSPAIVQAIEALDVNRAVCTDYWDSRPYSRPQVQFPAN  1136
                :   *  :*::;***:  **  :::.  ****  ::    :**:   :

JMJ18    ---NQTSSDSKDHFISSNCSAS--------------LTKGKLFGVDLM-------  819
JMJ15    ---NERDSLEMRKDCFMSNSSQS--------------LSKARLFGVDLN-------  806
JMJ14    EPIKEGERKDDTEKGGASDPSLDRDTRLLRGLLKKATPEELVMMHGLLCGETRNTELKEEL  943
PKDM7D   PLLREANTSGRSNVGNLQLNPGHHISPTGINSILKVLFKKASMEELSSLQEVLSETNSDM  1196
                .:  ..     ..     :  . .

JMJ18    --------------
JMJ15    --------------
JMJ14    STLVDKMEISP--  954
PKDM7D   VTELVKEEIQNRR  1209
```

FIG. 3B

```
RDR2    ---MVSETTTNRSTVKISNVPQTIVADELLRFLELHLGEDTVFALEIPTTRDNWK-----  52
RDR1    ----------MGKTIQVFGFPNGVSAEEVKKFLERLTGSGTVYAIKVRQPKKGG------  44
RDR6    MGSEGNMKKSVVTQVSIGGFGESTTAKQLTDYLEDEVGIVWRCRLKTSWTPPGSYPNFEI  60
                 .  :.:  ..  :     *.::   :**    *       ::    .  .

RDR2    ---------------PRDFARVQFTTLEVKSRAQLLSSQSKLLFKTHNLRLSEAYDD----  94
RDR1    ---------------PRVYAIVQFTS-ERHTRLIITAAAERLYYGRSYLKAFEVEQD----  85
RDR6    ADTSNIPSIDEYKKVEPHAFVHFAVFESAGRAMDAAGQCNLILDGQPLKVSLGPKNPYSL 120
                        .* *:*:    *    *       :.  .*      *:     .:

RDR2    IIPRPVDPRKRLDDIVLTVGFPESDEKRFCALEKWDGVRCWILTEKRRVEFWVWESGDCY 154
RDR1    IVPKPRASLHTISGLKMFFGCQVS-TKKFLTLWSAQDVCVSFGIGMRKLHFSFSWYQKDY 144
RDR6    NQRRRTTVPYKLAGITLEIGTLVS-RDDFFVSWRAEGVDFLVDPFDNTCKFCFRKSTAFS 179
         :             :   .:  .*    *   .  *      :.*   .    .*  .

RDR2    KIEVRFEDIIETLSCCVNGDASEIDAFLLKLYGPKVFKRVTVHIATKFKSDRYRFCKED  214
RDR1    RLELSYENIWQIDLHSPQGRSSKF--LVIQVIGAPKIFEKEDQPINLLFG--IMDFYSDG 200
RDR6    FKDAVMHAVINCDYKLELLVRDIQTVRQYKTLHGFVLILQLASSPRVWYRTADDDIYDTV 239
         :   . : :        .      :         .    :: :           :  .

RDR2    F------DFMWIRTTDFSGSKSIGTSTCFCLEVHNGSTMLDIFSGLPYYREDTLSLTYVD 268
RDR1    S------DEQWIRTTDFTSSSCIGQSTAFCLELPVHLNVPDFRENFANYAEHRASSFLIE 254
RDR6    PGDLLDDDDPWIRTTDFTQVGAIGRCHSYRVLISPRYEN-KLRTALDYFRMRRVQEERVR 298
               * *******;  .**  . .: : :       .:    : :        :

RDR2    -GKTFASAAQIVPLLNAAILGLEFPYEILFQLNALVHAQKISLFAASDMELIKILRGMSL 327
RDR1    SGSSYSSNANTLVPVVDPPPGFSLPFEILFKLNTLVQNACLSG-PALDLDFYRLLNQKKY 313
RDR6    WPPRIRNEPCFGEPVSDHFFCIHHKEGISFEIMFLVNSVLHRGVFNQFQLTERFFDLLRN 358
          . .        :         :      * *::  **:               :::

RDR2    ETALV--ILKKLHQQSSICYDPVFFVKTQMQSVVKKMKHSPASAYKRLTEQNIMSCQRAY 385
RDR1    DRALIDHCLEKLFHLGECCYEPAHWLRDEYKKWISKGK-LPLSPTISLDDG-LVYMYRVQ 371
RDR6    QPKDVN---IASLKHLCTYKRPVFDAYKRLKLVQEWIQKNPKLLGSHEQSEDISEIRRLV 415
         :   :      :       *..    . :  .  :   *        . :      *

RDR2    VTPSKIYLLGPELETANYVVKNFAEHVSDFMRVTFVEEDWSKLPANALS-----VNSKEG 440
RDR1    VTPARVYFSGPEVNVSNRVLRHYSKYINNFLRVSFVDEDLEKVRSMDLS-----PRSS-- 424
RDR6    ITPTRAYCLPPEVELSNRVLRRYKAVAERFLRVTFMDESMQTINSNVLSYFVAPIVKDLT 475
        :**:: *   **:: :* *::.:     . *:**:*:.*.   ..: :    **     ..

RDR2    YFVKPSRTNIYNRVLSILGEGITVGPKRFEFLAFSASQLRGNSVWMFASNEKVKAEDIRE 500
RDR1    ---TQRRTKLYDRIYSVLRDGIVIGDKKFEFLAFSSSQLRENSAWMFAPIDRITAAHIRA 481
RDR6    SSSFSQKTYVFKRVKSILTDGFKLCGRKYSFLAFSANQLRDRSAWFFAEDGKTRVSDIKT 535
         :*   ::.*: *:*  :*:   :   :::.*****:.*** .*.*;**    :   .  .*:

RDR2    WMGCFRKIRSISKCAARMGQLFSASRQTLIVRAQDVE-QIPDIEVTTDGADYCFSDGIGK 559
RDR1    WMGDFDHIRNVAKYAARLGQSFSSSRETLNVRSDEIE-VIPDVEIISLGTRYVFSDGIGK 540
RDR6    WMGKFKDK-NVAKCAARMGLCFSSTYATVDVMPHEVDTEVPDIERN----GYVFSDGIGT 590
        ***  *   . .:*  ***:*  **::    *:    *:  *  ..:::    :**:*    * ******.

RDR2    ISLAFAKQVAQKCGLSHV--PSAFQIRYGGYKGVIAVDRSSFR--KLSLRDSMLKFDSNN 615
RDR1    ISAEFARKVARKCGLTEFS-PSAFQIRYGGYKGVVAVDPNSSK--KLSLRKSMSKFESEN 597
RDR6    ITPDLADEVMEKLKLDVHYSPCAYQIRYAGFKGVVARWPSKSDGIRLALRDSMKKFFSKH 650
        *:  :*  :* .*   *          *.*:****.*:***:*    ..     :*:**.**  **  *::

RDR2    RMLNVTRWTESMPCFLNREIICLLSTLGIEDAMFEAMQAVHLSMLGNMLEDRDAALNVLQ 675
RDR1    TKLDVLAWSKYQPCYMNRQLITLLSTLGVTDSVFEKKQREVVDRLDAILTHPLEAHEALG 657
RDR6    TILEICSWTRFQPGFLNRQIITLLSVLGVPDEIFWDMQESMLYKLNRILDDTDVAFEVLT 710
         *::    *:.      *  ::**::*   ***.**; *  :*         *   *.:*  .     *  :.*

RDR2    KLSGENSKNLLVKMLLQGYAPSSEPYLSMMLRVHHESQLSELKSRCRILVPKGRILIGCM 735
```

FIG. 4A

```
RDR1    LMAPGENTNILKALILCGYKPDAEPFLSMMLQNFRASKLLELRTKTRIFISGGRSMMGCL  717
RDR6    ASCAEQG-NTAAIMLSAGFKPKTEPHLRGMLSSVRIAQLWGLREKSRIFVTSGRWLMGCL  769
        .  :. *    ::  *: *.**.*  **    : ::* *: : **::. ** ::**:

RDR2    DEMGILEYGQVYVRVTLT-KAELKSRDQSYFRKIDEETSVVIGKVVVTKNPCLHPGDIRV  794
RDR1    DETRTLEYGQVVVQYSDP-MRPGRR-------------FIITGPVVVAKNPCLHPGDVRV  763
RDR6    DEAGILEHGQCFIQVSKPSIENCFSKHGSRFKETKTDLEVVKGYVAIAKNPCLHPGDVRI  829
        **  **:**  ::  :  .               :: * *.::**********:*;

RDR2    LDAIYEVHFEEKGYLDCIIFPQKGERPHPNECSGGDLDGDQFFVSWDEKIIPS--EMDPP  852
RDR1    LQAVNVPALN--HMVDCVVFPQKGLRPHPNECSGSDLDGDIYFVCWDQELVPP--RTSEP  819
RDR6    LEAVDVPQLH--HMYDCLIFPQKGDRPHTNEASGSDLDGDLYFVAWDQKLIPPNRKSYPA  887
        *:*:        :.    **::***** ***.**.**.***** :**.**:::*. . .

RDR2    MDYAGSRPRLMDHDVTLEEIHKFFVDYMISDTLGVISTAHLVHADRDPEKARSQKCLELA  912
RDR1    MDYTPEPTQILDHDVTIEEVEKYFANYIVNDSLGIIANAHTAFADKEPLKAFSDPCIELA  879
RDR6    MHYDAAEEKSLGRAVNHQDIIDFFARNLANEQLGTICNAHVVHADRSEYGAMDKECLLLA  947
        *.*      : :.: *. ::: ..:*.   : .: ** *...** ..**:.  * .:*: **

RDR2    NLHSRAVDFAKTGAPAEMPYALKPREFPDFLERFEKPTYISESVFGKLYRAVKS---SLA  969
RDR1    KKFSTAVDFPKTGVAAVIPQHLYVKEYPDFMEKPDKPTYESKNVIGKLFREVKERAPPLI  939
RDR6    ELAATAVDFPKTGKIVSMPFHLKPKLYPDFMGKEDYQTYKSNKILGRLYRRVKEVYDEDA  1007
         :  :****.***   .:*  * :  :*** : :  ** *:.::*:*:*  **.

RDR2    QRKPE-AESEDTVAYDVTLEEAGFESFIETAKAHRDMYGEKLTSLMIYYGAANEEEILTG  1028
RDR1    SIKSF-TLDVASKSYDKDMEVDGFEEYVDEAFYQKANYDFKLGNLMDYYGIKTEAEILSG  998
RDR6    EASSEESTDPSAIPYDAVLEIPGFEDLIPEAWGHKCLYDGQLIGLLGQYKVQKEEEIVTG  1067
         . ..   : . .:**  :* ***.  :  *  :: *. :* .*:   *   .* **::*

RDR2    -ILKTKEMYLARDNRRYGDMKDRITLSVKDLHKEAMGWFEKSCEDEQQKK---------K  1078
RDR1    GIMRMSKSFTKRRD------AESIGRAVRALRKETLSLFNAS-EEEENES---------A  1042
RDR6    HIWSMPKYTSKKQG----ELKERLKHSYNSLKKEFRKVFEETIPDHENLSEEEKNILYEK  1123
         *   : .  : .      ::   :  .  *:** *: :  :.:: .

RDR2    LASAWYYVTYNPNHR--------DEKLT---FLSFPWIVGDVLLDIKAEN--AQRQSVEE  1125
RDR1    KASAWYHVTYHSSYWGL-----YNEGLNRDHFLSFAWCVYDKLVRIKKTN--LGRRQRQE  1095
RDR6    KASAWYHVTYHPEWVKKSLELQDPESSHAAMLSFAWIAADYLARIKIRSREMGSIDSAK  1183
        *****:***:..        :  .  :***.* . * **   .    . :

RDR2    KTSGLVSI----- 1133
RDR1    TLERLDHVLRFG- 1107
RDR6    PVDSLAKFLAQRL 1196
              . * .
```

METHODS AND COMPOSITIONS FOR TARGETING RNA POLYMERASES AND NON-CODING RNA BIOGENESIS TO SPECIFIC LOCI

CROSS-REFERENCE TO RELATED APPLICATIONS

This application is a U.S. National Stage Patent Application under 35 U.S.C. § 371 of International Application No. PCT/US2017/034844, filed internationally on May 26, 2017, which claims the benefit of U.S. Provisional Application No. 62/342,814, filed on May 27, 2016, and U.S. Provisional Application No. 62/450,504, filed on Jan. 25, 2017, the disclosures of each of which are incorporated herein by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 262232001100SUBSEQLIST.txt, date recorded: Aug. 15, 2019, size: 3,509 KB).

FIELD

The present disclosure relates to the use of recombinant proteins for inducing epigenetic modifications at specific loci, as well as to methods of using these recombinant proteins for reducing the expression of genes in plants.

BACKGROUND

Epigenetic marks are enzyme-mediated chemical modifications of DNA and of its associated chromatin proteins. Although epigenetic marks do not alter the primary sequence of DNA, they do contain heritable information and play key roles in regulating genome function. Such modifications, including cytosine methylation, posttranslational modifications of histone tails and the histone core, and the positioning of nucleosomes (histone octamers wrapped with DNA), influence the transcriptional state and other functional aspects of chromatin. For example, methylation of DNA and certain residues on the histone H3 N-terminal tail, such as H3 lysine 9 (H3K9), are important for transcriptional gene silencing and the formation of heterochromatin. Such marks are essential for the silencing of nongenic sequences, including transposons, pseudogenes, repetitive sequences, and integrated viruses, that become deleterious to cells if expressed and hence activated. Epigenetic gene silencing is also important in developmental phenomena such as imprinting in both plants and mammals, as well as in cell differentiation and reprogramming. Having the ability to specifically control target gene silencing is thus of great interest.

Different pathways involved in epigenetic silencing have been previously described, and include histone deacetylation, H3K27 and H3K9 methylation, H3K4 demethylation, and DNA methylation of promoters. An avenue to achieve DNA methylation is via a phenomenon known as RNA-directed DNA methylation, where non-coding RNAs act to direct methylation of a DNA sequence. In plants, proteins generally do not link the recognition of a specific DNA sequence with the establishment of an epigenetic state. Thus, endogenous plant epigenetic regulators generally cannot be used for epigenetic silencing of specific genes or transgenes in plants.

Accordingly, a need exists for improved epigenetic regulators that are capable of being targeted to specific loci to induce epigenetic gene silencing activity in plants.

BRIEF SUMMARY

The present disclosure relates to a method for reducing expression of one or more target nucleic acids in a plant, the method including: (a) providing a plant including a recombinant nucleic acid encoding a recombinant polypeptide including a nuclease-deficient CAS9 polypeptide (dCAS9) or fragment thereof and a polypeptide selected from an SHH1 polypeptide or fragment thereof, an SHH2 polypeptide or fragment thereof, an AGO4 polypeptide or fragment thereof, an HDA6 polypeptide or fragment thereof, an NRPD1 polypeptide or fragment thereof, an NRPE1 polypeptide or fragment thereof, a JMJ14 polypeptide or fragment thereof, an RDR2 polypeptide or fragment thereof, an NRPD2A/NRPE2 polypeptide or fragment thereof, an NRPB3/NRPD3/NRPE3A polypeptide or fragment thereof, an NRPE3B polypeptide or fragment thereof, an NRPB11/NRPD11/NRPE11 polypeptide or fragment thereof, an NRPB10/NRPD10/NRPE10 polypeptide or fragment thereof, an NRPB12/NRPD12/NRPE12 polypeptide or fragment thereof, an NRPB6A/NRPD6A/NRPE6A polypeptide or fragment thereof, an NRPB6B/NRPD6B/NRPE6B polypeptide or fragment thereof, an NRPB8A/NRPE8A polypeptide or fragment thereof, an NRPB8B/NRPD8B/NRPE8B polypeptide or fragment thereof, an NRPE5 polypeptide or fragment thereof, an NRPD4/NRPE4 polypeptide or fragment thereof, an NRPE7 polypeptide or fragment thereof, an NRPD7 polypeptide or fragment thereof, an NRPB5/NRPD5 polypeptide or fragment thereof, an NRPB9A/NRPD9A/NRPE9A polypeptide or fragment thereof, an NRPB9B/NRPD9B/NRPE9B polypeptide or fragment thereof, an ATRX polypeptide or fragment thereof, a MOM1 polypeptide or fragment thereof, a MORC1 polypeptide or fragment thereof, an SssI polypeptide or fragment thereof, a DRM2-MTase polypeptide or fragment thereof, a DNMT3A polypeptide or fragment thereof, a DNMT3L polypeptide or fragment thereof, an MBD9 polypeptide or fragment thereof, a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof, an RDM1 polypeptide or a fragment thereof, a DRM3 polypeptide or a fragment thereof, a DRM2 polypeptide or a fragment thereof, and an FRG polypeptide or a fragment thereof; and a crRNA and tracrRNA, or fusions thereof; and (b) growing the plant under conditions where the recombinant nucleic acid is expressed and where the recombinant polypeptide is targeted to the one or more target nucleic acids, thereby reducing expression of the one or more target nucleic acids. In some embodiments, the recombinant polypeptide interacts with an RNA polymerase. In some embodiments, the RNA polymerase is RNA polymerase IV or RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure also relates to a recombinant nucleic acid which encodes a recombinant polypeptide including a nuclease-deficient CAS9 polypeptide (dCAS9) or fragment thereof and a polypeptide selected from an SHH1 polypeptide or fragment thereof, an SHH2 polypeptide or fragment thereof, an AGO4 polypeptide or fragment thereof, an HDA6 polypeptide or fragment thereof, an NRPD1 polypeptide or fragment thereof, an NRPE1 polypeptide or fragment thereof, a JMJ14 polypeptide or fragment thereof, an RDR2 polypeptide or fragment thereof, an NRPD2A/NRPE2 polypeptide or fragment thereof, an NRPB3/NRPD3/NRPE3A polypeptide or fragment thereof, an NRPE3B polypeptide or fragment thereof, an NRPB11/NRPD11/NRPE11 polypeptide or fragment thereof, an NRPB10/NRPD10/NRPE10 polypeptide or fragment thereof, an NRPB12/NRPD12/NRPE12 polypeptide or fragment thereof, an NRPB6A/NRPD6A/NRPE6A polypeptide or fragment thereof, an NRPB6B/NRPD6B/NRPE6B polypeptide or fragment thereof, an NRPB8A/NRPE8A polypeptide or fragment thereof, an NRPB8B/NRPD8B/NRPE8B polypeptide or fragment thereof, an NRPE5 polypeptide or fragment thereof, an NRPD4/NRPE4 polypeptide or fragment thereof, an NRPE7 polypeptide or fragment thereof, an NRPD7 polypeptide or fragment thereof, an NRPB5/NRPD5 polypeptide or fragment thereof, an NRPB9A/NRPD9A/NRPE9A polypeptide or fragment thereof, an NRPB9B/NRPD9B/NRPE9B polypeptide or fragment thereof, an ATRX polypeptide or fragment thereof, a MOM1 polypeptide or fragment thereof, a MORC1 polypeptide or fragment thereof, an SssI polypeptide or fragment thereof, a DRM2-MTase polypeptide or fragment thereof, a DNMT3A polypeptide or fragment thereof, a DNMT3L polypeptide or fragment thereof, an MBD9 polypeptide or fragment thereof, a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof, an RDM1 polypeptide or a fragment thereof, a DRM3 polypeptide or a fragment thereof, a DRM2 polypeptide or a fragment thereof, and an FRG polypeptide or a fragment thereof. The present disclosure further relates to expression vectors including the recombinant nucleic acid of the preceding embodiment, and a host cell including the expression vector of the preceding embodiment. In some embodiments, the host cell is a plant cell. The present disclosure also relates to a recombinant plant including the recombinant nucleic acids of the preceding embodiments.

Other aspects of the present disclosure relate to a plant having reduced expression of one or more target nucleic acids according to the method of any one of the preceding embodiments, as well as a progeny plant of the plant of the preceding embodiment. In some embodiments, the progeny plant has reduced expression of the one or more target nucleic acids and does not include the recombinant nucleic acid.

The present disclosure also relates to a method for reducing expression of one or more target nucleic acids in a plant, the method including: (a) providing a plant including: a recombinant nucleic acid encoding a recombinant polypeptide selected from an SHH1-like protein, an SHH2-like protein, an AGO4-like protein, an HDA6-like protein, an NRPD1-like protein, an NRPE1-like protein, a JMJ14-like protein, an RDR2-like protein, an NRPD2A/NRPE2-like protein, an NRPB3/NRPD3/NRPE3A-like protein, an NRPE3B-like protein, an NRPB11/NRPD11/NRPE11-like protein, an NRPB10/NRPD10/NRPE10-like protein, an NRPB12/NRPD12/NRPE12-like protein, an NRPB6A/NRPD6A/NRPE6A-like protein, an NRPB6B/NRPD6B/NRPE6B-like protein, an NRPB8A/NRPE8A-like protein, an NRPB8B/NRPD8B/NRPE8B-like protein, an NRPE5-like protein, an NRPD4/NRPE4-like protein, an NRPE7-like protein, an NRPD7-like protein, an NRPB5/NRPD5-like protein, an NRPB9A/NRPD9A/NRPE9A-like protein, an NRPB9B/NRPD9B/NRPE9B-like protein, an ATRX-like protein, a MOM1-like protein, a MORC1-like protein, an SssI-like protein, a DRM2-MTase-like protein, a DNMT3A-like protein, a DNMT3L-like protein, a MBD9-like protein, an SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and an FRG-like protein; and a crRNA and tracrRNA, or fusions thereof, and where the plant expresses a dCAS9 protein; and (b) growing the plant under conditions where the recombinant nucleic acid is expressed and where the recombinant polypeptide is targeted to the one or more target nucleic acids, thereby reducing expression of the one or more target nucleic acids. In some embodiments, the recombinant polypeptide includes a dCAS9 protein or fragment thereof. In some embodiments, the recombinant polypeptide includes an MS2 coat protein or fragment thereof. In some embodiments, the recombinant polypeptide includes an scFV antibody or fragment thereof. In some embodiments that may be combined with any of the preceding embodiments, the recombinant polypeptide interacts with an RNA polymerase. In some embodiments, the RNA polymerase is RNA polymerase IV or RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

The present disclosure also relates to a recombinant nucleic acid which encodes a recombinant polypeptide selected from an SHH1-like protein, an SHH2-like protein, an AGO4-like protein, an HDA6-like protein, an NRPD1-like protein, an NRPE1-like protein, a JMJ14-like protein, an RDR2-like protein, an NRPD2A/NRPE2-like protein, an NRPB3/NRPD3/NRPE3A-like protein, an NRPE3B-like protein, an NRPB11/NRPD11/NRPE11-like protein, an NRPB10/NRPD10/NRPE10-like protein, an NRPB12/NRPD12/NRPE12-like protein, an NRPB6A/NRPD6A/NRPE6A-like protein, an NRPB6B/NRPD6B/NRPE6B-like protein, an NRPB8A/NRPE8A-like protein, an NRPB8B/NRPD8B/NRPE8B-like protein, an NRPE5-like protein, an NRPD4/NRPE4-like protein, an NRPE7-like protein, an NRPD7-like protein, an NRPB5/NRPD5-like protein, an NRPB9A/NRPD9A/NRPE9A-like protein, an NRPB9B/NRPD9B/NRPE9B-like protein, an ATRX-like protein, a MOM1-like protein, a MORC1-like protein, an SssI-like protein, a DRM2-MTase-like protein, a DNMT3A-like protein, a DNMT3L-like protein, a MBD9-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and an FRG-like protein. The present disclosure further relates to expression vectors including the recombinant nucleic acid of the preceding embodiment, and a host cell including the expression vector of the preceding embodiment. In some embodiments, the host cell is a plant cell. The present disclosure also relates to a recombinant plant including the recombinant nucleic acids of the preceding embodiments.

Other aspects of the present disclosure relate to a plant having reduced expression of one or more target nucleic acids according to the method of any one of the preceding embodiments, as well as a progeny plant of the plant of the preceding embodiment. In some embodiments, the progeny plant has reduced expression of the one or more target nucleic acids and does not include the recombinant nucleic acid.

The present disclosure also relates to a method for reducing expression of one or more target nucleic acids in a plant, including: (a) providing a plant including a recombinant nucleic acid, where the recombinant nucleic acid encodes a recombinant polypeptide including a first amino acid sequence including a DNA-binding domain and a second amino acid sequence including a polypeptide selected from the group of an SHH1 polypeptide or fragment thereof, an SHH2 polypeptide or fragment thereof, an AGO4 polypeptide or fragment thereof, an HDA6 polypeptide or fragment thereof, an NRPD1 polypeptide or fragment thereof, an NRPE1 polypeptide or fragment thereof, a JMJ14 polypeptide or fragment thereof, an RDR2 polypeptide or fragment thereof, an NRPD2A/NRPE2 polypeptide or fragment thereof, an NRPB3/NRPD3/NRPE3A polypeptide or fragment thereof, an NRPE3B polypeptide or fragment thereof, an NRPB11/NRPD11/NRPE11 polypeptide or fragment thereof, an NRPB10/NRPD10/NRPE10 polypeptide or fragment thereof, an NRPB12/NRPD12/NRPE12 polypeptide or fragment thereof, an NRPB6A/NRPD6A/NRPE6A polypeptide or fragment thereof, an NRPB6B/NRPD6B/NRPE6B polypeptide or fragment thereof, an NRPB8A/NRPE8A polypeptide or fragment thereof, an NRPB8B/NRPD8B/NRPE8B polypeptide or fragment thereof, an NRPE5 polypeptide or fragment thereof, an NRPD4/NRPE4 polypeptide or fragment thereof, an NRPE7 polypeptide or fragment thereof, an NRPD7 polypeptide or fragment thereof, an NRPB5/NRPD5 polypeptide or fragment thereof, an NRPB9A/NRPD9A/NRPE9A polypeptide or fragment thereof, an NRPB9B/NRPD9B/NRPE9B polypeptide or fragment thereof, an ATRX polypeptide or fragment thereof, a MOM1 polypeptide or fragment thereof, a MORC1 polypeptide or fragment thereof, an SssI polypeptide or fragment thereof, a DRM2-MTase polypeptide or fragment thereof, a DNMT3A polypeptide or fragment thereof, a DNMT3L polypeptide or fragment thereof, an MBD9 polypeptide or fragment thereof, a SUVH2 polypeptide or a fragment thereof, a SUVH9 polypeptide or a fragment thereof, a DMS3 polypeptide or a fragment thereof, a MORC6 polypeptide or a fragment thereof, a SUVR2 polypeptide or a fragment thereof, a DRD1 polypeptide or a fragment thereof, an RDM1 polypeptide or a fragment thereof, a DRM3 polypeptide or a fragment thereof, a DRM2 polypeptide or a fragment thereof, and an FRG polypeptide or a fragment thereof, and (b) growing the plant under conditions where the recombinant polypeptide encoded by the recombinant nucleic acid is expressed and binds to the one or more target nucleic acids, thereby reducing expression of the one or more target nucleic acids. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from the group of a Cys2His2 (C2H2) zinc finger domain, a CCCH zinc finger domain, a multi-cysteine zinc finger domain, and a zinc binuclear cluster domain. In some embodiments, the DNA-binding domain is selected from the group of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments, the DNA-binding domain includes a TAL effector targeting domain. In some embodiments, the DNA-binding domain includes three C2H2 zinc finger domains. In some embodiments, the recombinant polypeptide interacts with an RNA polymerase. In some embodiments, the RNA polymerase is RNA polymerase IV or RNA polymerase V. In some embodiments that may be combined with any of the preceding embodiments, the recombinant polypeptide induces RNA-directed DNA methylation. In some embodiments that may be combined with any of the preceding embodiments, the one or more target nucleic acids are endogenous nucleic acids. In some embodiments that may be combined with any of the preceding embodiments, the one or more target nucleic acids are heterologous nucleic acids. In some embodiments that may be combined with any of the preceding embodiments, expression of the one or more target nucleic acids is silenced.

In another aspect, the present disclosure provides a method for reducing expression of one or more target nucleic acids in a plant, including: (a) providing a plant including a recombinant polypeptide selected from an SHH1-like protein, an SHH2-like protein, an AGO4-like protein, an HDA6-like protein, an NRPD1-like protein, a JMJI4-like protein, an RDR2-like protein, an NRPD2A/NRPE2-like protein, an NRPB3/NRPD3/NRPE3A-like protein, an NRPE3B-like protein, an NRPB11/NRPD11/NRPE11-like protein, an NRPB10/NRPD10/NRPE10-like protein, an NRPB12/NRPD12/NRPE12-like protein, an NRPB6A/NRPD6A/NRPE6A-like protein, an NRPB6B/NRPD6B/NRPE6B-like protein, an NRPB8A/NRPE8A-like protein, an NRPB8B/NRPD8B/NRPE8B-like protein, an NRPE5-like protein, an NRPD4/NRPE4-like protein, an NRPE7-like protein, an NRPD7-like protein, an NRPB5/NRPD5-like protein, an NRPB9A/NRPD9A/NRPE9A-like protein, an NRPB9B/NRPD9B/NRPE9B-like protein, an ATRX-like protein, a MOM1-like protein, a MORC1-like protein, an SssI-like protein, a DRM2-MTase-like protein, a DNMT3A-like protein, a DNMT3L-like protein, a MBD9-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and an FRG-like protein; and (b) growing the plant under conditions whereby the recombinant polypeptide is targeted to the one or more target nucleic acids, thereby reducing expression of the one or more target nucleic acids.

In another aspect, the present disclosure provides a method for reducing expression of one or more target nucleic acids in a plant, including: (a) providing a plant including: a first recombinant polypeptide including a nuclease-deficient CAS9 polypeptide (dCAS9) or fragment thereof and a multimerized epitope; a second recombinant polypeptide including a DRM2-MTase polypeptide or a DNMT3A-DNMT3L fusion polypeptide, and an affinity polypeptide that specifically binds to the epitope; a crRNA and a tracrRNA, or fusions thereof; and (b) growing the plant under conditions whereby the first and second recombinant polypeptides are targeted to the one or more target nucleic acids, thereby reducing expression of the one or more target nucleic acids.

In another aspect, the present disclosure provides a recombinant vector including: a first nucleic acid sequence including a plant promoter and that encodes a recombinant polypeptide including a nuclease-deficient CAS9 polypeptide (dCAS9) or fragment thereof and a multimerized epitope; a second nucleic acid sequence including a plant promoter and that encodes a recombinant polypeptide including a DRM2-MTase polypeptide or a DNMT3A-DNMT3L fusion polypeptide, and an affinity polypeptide that specifically binds to the epitope; and a third nucleic acid sequence including a promoter and that encodes a crRNA and a tracrRNA, or fusions thereof. Also provided are host cells including the vector of the preceding embodiment, and a recombinant plant including the vector of the preceding embodiment.

In another aspect, the present disclosure provides a plant having reduced expression of one or more target nucleic acids as a consequence of the method of any of the preceding embodiments. Also provided is a progeny plant of the plant of the preceding embodiment. In some embodiments, the progeny plant has reduced expression of the one or more target nucleic acids and does not include the recombinant polypeptide targeted to the one or more target nucleic acids.

DESCRIPTION OF THE FIGURES

FIG. 1A and FIG. 1B illustrate an alignment of AGO4 (SEQ ID NO: 15) and related proteins AGO9 (SEQ ID NO: 364) and AGO6 (SEQ ID NO: 363) from *A. thaliana*.

FIG. 2 illustrates an alignment of HDA6 (SEQ ID NO: 28) and related proteins HDA1 (SEQ ID NO: 365), HDA9 (SEQ ID NO: 367) and HDA7 (SEQ ID NO: 366) from *A. thaliana*.

FIG. 3A and FIG. 3B illustrate an alignment of JMJ14 (SEQ ID NO: 80) and related proteins JMJ18 (SEQ ID NO: 376), JMH15 (SEQ ID NO: 377) and PKDM7D (SEQ ID NO: 378) from *A. thaliana*.

FIG. 4A and FIG. 4B illustrate an alignment of RDR2 (SEQ ID NO: 132) and related proteins RDR1 (SEQ ID NO: 389) and RDR6 (SEQ ID NO: 898) from *A. thaliana*.

FIG. 41 illustrates amino acid alignment of the methyl-binding domain of different MBD proteins from *Arabidopsis* and humans, including HsMeCP2 (SEQ ID NO: 902), HsMBD2 (SEQ ID NO: 903), HsMBD1 (SEQ ID NO: 904), AtMBD5 (SEQ ID NO: 905), AtMBD6 (SEQ ID NO: 906), AtMBD7 (SEQ ID NO: 907), AtMBD2 (SEQ ID NO: 908), AtMBD12 (SEQ ID NO: 909), AtMBD12 (SEQ ID NO: 910), AtMBD4 (SEQ ID NO: 911), AtMBD3 (SEQ ID NO: 912), AtMBD10 (SEQ ID NO: 913), AtMBD9 (SEQ ID NO: 914), and AtMBD8 (SEQ ID NO: 915). Red indicates high amino acid conservation while blue indicates low conservation. Proteins were aligned using CLC Main Workbench software.

DETAILED DESCRIPTION

Overview

Figure 5:
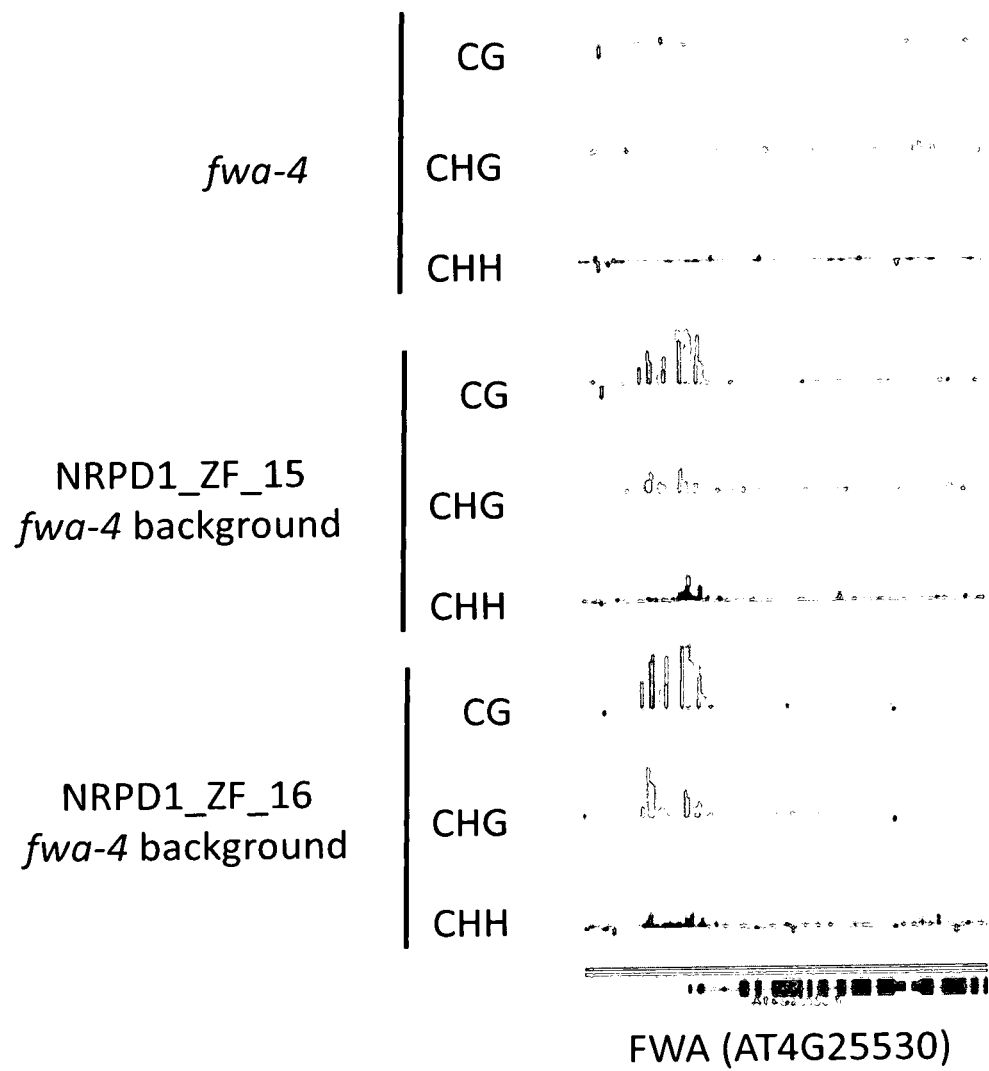
FIG. 5 illustrates bisulfite sequencing results of an exemplary NRPD1-ZF transgenic line in an fwa-4 mutant background that exhibited early flowering.

The following description is presented to enable a person of ordinary skill in the art to make and use the various embodiments. Descriptions of specific devices, techniques, methods, and applications are provided only as examples. Various modifications to the examples described herein will be readily apparent to those of ordinary skill in the art, and the general principles defined herein may be applied to other examples and applications without departing from the spirit and scope of the various embodiments. Thus, the various embodiments are not intended to be limited to the examples described herein and shown.

The present disclosure relates to the use of recombinant proteins for inducing epigenetic modifications at specific loci, as well as to methods of using these recombinant proteins for reducing the expression of genes in plants.

In *Arabidopsis*, establishment of all DNA methylation and maintenance of much of the non-CG methylation involves the RNA-directed DNA methylation (RdDM) pathway (Aufsatz et al., 2002; Pelissier and Wassenegger, 2000). DNA methylation is first established by a protein called DRM2 and is targeted by 24 nt small interfering RNAs (siRNAs) through the RdDM pathway that involves two plant-specific RNA polymerases: RNA Polymerase IV (Pol IV), which functions to initiate siRNA biogenesis; and RNA Polymerase V (Pol V), which functions in the downstream DNA methyltransferase targeting phase of the RdDM pathway to generate non-coding scaffold transcripts that recruit downstream RdDM factors. Thus, RNA-directed DNA methylation (RdDM) in *Arabidopsis* involves both the synthesis of non-coding, small-interfering RNAs by Pol IV and the synthesis of non-coding scaffold RNAs by Pol V.

Specifically, and without wishing to be bound by theory, it is believed that there are two main steps in this pathway that are thought to target the DNA methyltransferase, DOMAINS REARRANGED METHYLTRANSFERASE 2 (DRM2)(Cao and Jacobsen, 2002). The first upstream step involves the synthesis of 24 nucleotide small interfering RNAs (siRNAs) by the concerted actions of RNA POLYMERASE IV (Pol IV or NRPD), RNA-DIRECTED RNA POLYMERASE 2 (RDR2) and DICER-LIKE 3 (DCL3) (Pontier et al., 2005). The second downstream step involves the production of scaffold transcripts by RNA POLYMERASE V (Pol V or NRPE) with the help of the DDR complex (DRD1, a SWI/SNF2 chromatin remodeler; DMS3, a chromosomal architectural protein; RDM1, unknown function). Without wishing to be bound by theory, it is then believed that ARGONAUTE 4 (AGO4) loaded with a 24 nucleotide siRNA binds to Pol V transcripts and, in an unknown fashion, acts to direct DRM2 to DNA for methylation (Law et al., 2010; Pikaard et al., 2008; Wierzbicki et al., 2009).

It is clear that there are a multitude of proteins involved in the epigenetic regulation of plant genomes. Applicants have previously shown that a protein called SHH1 acts in the RdDM pathway to enable siRNA production from RdDM targets and that SHH1 is required for RNA polymerase IV (Pol IV) occupancy at these target loci. Applicants have also previously shown that Pol V association with chromatin is dependent on two proteins called SUVH2 and SUVH9. These results have also highlighted that the RdDM pathway is a self-reinforcing loop mechanism, meaning that targeting of various components in different parts of the pathway to DNA are likely to initiate the entire pathway and cause RNA-directed DNA methylation.

The present disclosure is based, at least in part, on Applicant's discovery that various epigenetic regulators may be recombinantly fused to a zinc finger DNA-binding domain that targets a specific nucleic acid sequence, and that the targeted nucleic acid is then silenced in plants harboring the genetically modified epigenetic regulator. Epigenetic regulators where this approach has been successful, as described herein, include e.g. SHH1, SHH2, AGO4, HDA6, NRPD1, NRPE1, JMJ14, RDR2, and NRPD2A/NRPE2. Advantageously, and without wishing to be bound by theory, such recombinant proteins can be used to recruit Pol IV and/or Pol V to target loci to induce RNA-directed DNA methylation at the target loci, and thus to silence the target loci.

Of particular note, Applicants have shown that various components of RNA Pol IV (e.g. NRPD1) and RNA Pol V (e.g. NRPE2) can be directly targeted to a specific locus using the methods of the present disclosure, as opposed to being recruited to the target locus via other epigenetic regulators involved in the RNA-directed DNA methylation pathway according to the methods of the present disclosure.

Various other components of RNA Pol IV and/or RNA Pol V may be used according to the methods of the present disclosure to target RNA Pol IV and/or RNA Pol V to a target locus and silence the locus.

Other exemplary proteins useful in the methods of the present disclosure for targeting Pol IV, Pol V, DNA methylation, and/or gene silencing to specific loci include e.g. any one of a modified NRPB3/NRPD3/NRPE3A, NRPE3B, NRPB11/NRPD11/NRPE11, NRPB10/NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, ATRX, MOM1, MORC1, SssI, DRM2-MTase, DNMT3A, DNMT3L, MBD9, SUVH2, SUVH9, DMS3, MORC6, SUVR2, DRD1, RDM1, DRM3, DRM2, FRG, and homologs and orthologs thereof. These proteins may be engineered to specifically bind different DNA sequences by introducing a heterologous DNA-binding domain into the protein or a fragment of the protein such as, for example, a heterologous zinc finger domain or TAL effector targeting domain.

Accordingly, the present disclosure provides methods for silencing specific loci in plants using one or more of an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein that have been engineered to specifically bind different DNA sequences via the introduction of a heterologous DNA-binding domain into the protein. Each one of the aforementioned modified proteins may be expressed in a host cell individually or in various combinations to act to silence a target locus. For example, a modified SHH1 protein having a heterologous DNA-binding domain may be expressed in a host cell to target Pol IV to a target locus in conjunction with one or more modified epigenetic regulators having a heterologous DNA-binding domain to target Pol V to that same target locus to trigger RNA-directed DNA methylation and epigenetic silencing of that target locus.

The present disclosure also provides modified epigenetic regulators such as, for example, a modified SHH1, SHH2, AGO4, HDA6, NRPD1, NRPE1, JMJ14, RDR2, NRPD2A/NRPE2, NRPB3/NRPD3/NRPE3A, NRPE3B, NRPB11/NRPD11/NRPE11, NRPB10/NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, ATRX, MOM1, MORC1, SssI, DRM2-MTase, DNMT3A, DNMT3L, MBD9, SUVH2, SUVH9, DMS3, MORC6, SUVR2, DRD1, RDM1, DRM3, DRM2, and/or FRG protein that can be targeted to a specific locus of interest using a CRISPR-CAS9 targeting system. CRISPR-CAS9 systems involve the use of a CRISPR RNA (crRNA), a trans-activating CRISPR RNA (tracrRNA), and a CAS9 protein. The crRNA and tracrRNA aid in directing the CAS9 protein to a target nucleic acid sequence, and these RNA molecules can be specifically engineered to target specific nucleic acid sequences. In particular, certain aspects of the present disclosure involve the use of a single guide RNA (gRNA) that reconstitutes the function of the crRNA and the tracrRNA. Further, certain aspects of the present disclosure involve a CAS9 protein that does not exhibit DNA cleavage activity (dCAS9). As disclosed herein, gRNA molecules may be used to direct the dCAS9 protein to a target nucleic acid sequence. By recombinantly fusing an epigenetic regulator of the present disclosure to a dCAS9 protein, use of the CRISPR targeting system allows for delivering an epigenetic regulator directly to a target nucleic acid. Once at the target nucleic acid, the epigenetic regulator can act to induce RNA-directed DNA methylation and epigenetic silencing of the target nucleic acid.

Accordingly, the present disclosure provides methods for CRISPR-targeting of an epigenetic regulator to a specific locus and for silencing that target locus in host cells using one or more proteins of the present disclosure such as, for example, an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein that is recombinantly fused to a CAS9 protein, such as a nuclease-deficient CAS9 protein. The methods of the present disclosure also involve the use of a crRNA and tracrRNA to interact with the target nucleic acid to be silenced. The crRNA and tracrRNA directs the recombinant protein of the present disclosure fused to a CAS9 protein to the target nucleic acid, thereby facilitating the epigenetic silencing of the target nucleic acid.

Each one of the aforementioned modified proteins may be expressed in a host cell individually or in various combinations to act to silence a target locus. For example, a modified SHH1 protein recombinantly fused to a CAS9 protein may be expressed in a host cell to target Pol IV and/or Pol V to a target locus in conjunction with one or more of the modified epigenetic regulators of the present disclosure to trigger RNA-directed DNA methylation and epigenetic silencing of that target locus.

The methods of the present disclosure for silencing target loci in host cells may also involve the introduction of small interfering RNAs (siRNAs) at a target locus in conjunction with Pol V targeting by one or more proteins of the present disclosure. Methods of generating siRNAs are well-known in the art. These methods include, for example, expression of hairpin RNAs that are naturally processed into small interfering RNAs in cells. Hairpin constructs that make small interfering RNAs are known in the art (EMBO Reports, 2006 November; 7(11):1168-75). Additional methods for generating siRNAs include, for example, the direct introduction of small interfering RNAs into a cell from exogenous sources. Methods describing bombardment of siRNAs into plants are known in the art (Science 328, 912 (2010)). RNA molecules may also be sprayed (exogenous application) onto a plant so that small RNAs can then be generated in a plant cell (See U.S. Patent Application 2014/0018241). Accordingly, the methods of the present disclosure for silencing target loci in host cells may also involve the introduction of small interfering RNAs (siRNAs) at a target locus in conjunction with Pol V targeting by one or more modified epigenetic regulators of the present disclosure.

Accordingly, certain aspects of the present disclosure relate to targeting an epigenetic regulator to a target nucleic acid using one or more SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins, or a fragment of the full-length coding sequence thereof, as well as containing a heterologous coding sequence that encodes a protein involved in the targeting and/or recruitment of the respective epigenetic regulator to a target nucleic acid via the CRISPR-CAS9 system. Thus, in some embodiments, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins are fusion proteins that have been engineered to specifically bind different DNA sequences via the introduction of a heterologous DNA-binding domain into the epigenetic regulator protein. Further, in some embodiments, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins are fusion proteins that are able to target and silence a specific nucleic acid with the use of an engineered CRISPR-CAS9 targeting system. The respective SHH1 protein, SHH2 protein, AGO4 protein, HDA6 protein, NRPD1 protein, NRPE1 protein, JMJ14 protein, RDR2 protein, NRPD2A/NRPE2 protein, NRPB3/NRPD3/NRPE3A protein, NRPE3B protein, NRPB11/NRPD11/NRPE11 protein, NRPB10/NRPD10/NRPE10 protein, NRPB12/NRPD12/NRPE12 protein, NRPB6A/NRPD6A/NRPE6A protein, NRPB6B/NRPD6B/NRPE6B protein, NRPB8A/NRPE8A protein, NRPB8B/NRPD8B/NRPE8B protein, NRPE5 protein, NRPD4/NRPE4 protein, NRPE7 protein, NRPD7 protein, NRPB5/NRPD5 protein, NRPB9A/NRPD9A/NRPE9A protein, NRPB9B/NRPD9B/NRPE9B protein, ATRX protein, MOM1 protein, MORC1 protein, SssI protein, DRM2-MTase protein, DNMT3A protein, DNMT3L protein, MBD9 protein, SUVH2 protein, SUVH9 protein, DMS3 protein, MORC6 protein, SUVR2 protein, DRD1 protein, RDM1 protein, DRM3 protein, DRM2 protein, and/or FRG protein portion of the corresponding epigenetic regulator-like protein may be present in various N-terminal or C-terminal orientations relative to the heterologous coding sequence.

Epigenetic regulators of the present disclosure such as, for example, any one of SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins may be combined and expressed in a host cell in various combinations.

In some embodiments, a JMJ14-like protein and an HDA6-like protein as described herein may be expressed in a host cell. In some embodiments, an SHH1-like protein, a DMS3-like protein, an HDA6-like protein, and a JMJ14-like protein may all be expressed in a host cell.

DNA-Binding Domains

Certain aspects of the present disclosure relate to epigenetic regulator-like proteins such as, for example, SHH1-like proteins, SHH2-like proteins, AGO4-like proteins, HDA6-like proteins, NRPD1-like proteins, NRPE1-like proteins, JMJI4-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins of the present disclosure, that have DNA-binding activity. In some embodiments, this DNA-binding activity is achieved through a heterologous DNA-binding domain (e.g. binds with a sequence affinity other than that of a DNA-binding domain that may be present in the endogenous protein). In some embodiments, recombinant proteins of the present disclosure contain a DNA-binding domain. Recombinant proteins of the present disclosure may contain one DNA binding domain or they may contain more than one DNA-binding domain. Heterologous DNA-binding domains may be recombinantly fused to an epigenetic regulator of the present disclosure such that the epigenetic regulator is then targeted to a specific nucleic acid sequence and can induce silencing of the specific nucleic acid sequence.

In some embodiments, the DNA-binding domain is a zinc finger domain. A zinc finger domain generally refers to a DNA-binding protein domain that contains zinc fingers, which are small protein structural motifs that can coordinate one or more zinc ions to help stabilize their protein folding. Zinc fingers were first identified as DNA-binding motifs (Miller et al., 1985), and numerous other variations of them have been characterized. Recent progress has been made that allows the engineering of DNA-binding proteins that specifically recognize any desired DNA sequence. For example, it was shown that a three-finger zinc finger protein could be constructed to block the expression of a human oncogene that was transformed into a mouse cell line (Choo and Klug, 1994).

Zinc fingers can generally be classified into several different structural families and typically function as interaction modules that bind DNA, RNA, proteins, or small molecules. Suitable zinc finger domains of the present disclosure may contain two, three, four, five, six, seven, eight, or nine zinc fingers. Examples of suitable zinc finger domains may include, for example, Cys2His2 (C2H2) zinc finger domains, C-x8-C-x5-C-x3-H (CCCH) zinc finger domains, multi-cysteine zinc finger domains, and zinc binuclear cluster domains.

In some embodiments, the DNA-binding domain binds a specific nucleic acid sequence. For example, the DNA-binding domain may bind a sequence that is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 20 nucleotides, at least 25 nucleotides, at least 30 nucleotides, at least 35 nucleotides, at least 40 nucleotides, at least 45 nucleotides, at least 50 nucleotides, or a high number of nucleotides in length.

In some embodiments, a recombinant protein of the present disclosure further contains two N-terminal CCCH zinc finger domains.

In some embodiments, the zinc finger domain is an engineered zinc finger array, such as a C2H2 zinc finger array. Engineered arrays of C2H2 zinc fingers can be used to create DNA-binding proteins capable of targeting desired genomic DNA sequences. Methods of engineering zinc finger arrays are well known in the art, and include, for example, combining smaller zinc fingers of known specificity.

In some embodiments, recombinant proteins of the present disclosure may contain a DNA-binding domain other than a zinc finger domain. Examples of such DNA-binding domains may include, for example, TAL (transcription activator-like) effector targeting domains, helix-turn-helix family DNA-binding domains, basic domains, ribbon-helix-helix domains, TBP (TATA-box binding protein) domains, barrel dimer domains, RHB domains (real homology domain), BAH (bromo-adjacent homology) domains, SANT domains, Chromodomains, Tudor domains, Bromodomains, PHD domains (plant homeo domain), WD40 domains, and MBD domains (methyl-CpG-binding domain).

In some embodiments, the DNA-binding domain is a TAL effector targeting domain. TAL effectors generally refer to secreted bacterial proteins, such as those secreted by *Xanthomonas* or *Ralstonia* bacteria when infecting various plant species. Generally, TAL effectors are capable of binding promoter sequences in the host plant, and activate the expression of plant genes that aid in bacterial infection. TAL effectors recognize plant DNA sequences through a central repeat targeting domain that contains a variable number of approximately 34 amino acid repeats. Moreover, TAL effector targeting domains can be engineered to target specific DNA sequences. Methods of modifying TAL effector targeting domains are well known in the art, and described in Bogdanove and Voytas, Science. 2011 September 30; 333 (6051):1843-6.

Other DNA-binding domains for use in the methods and compositions of the present disclosure will be readily apparent to one of skill in the art, in view of the present disclosure.

CRISPR-CAS9

Certain methods of the present disclosure relate to using a CRISPR-CAS9 targeting system to target an epigenetic regulator to a target nucleic acid and induce silencing of the target nucleic acid.

CRISPR systems naturally use small base-pairing guide RNAs to target and cleave foreign DNA elements in a sequence-specific manner (Wiedenheft et al., 2012). There are diverse CRISPR systems in different organisms that may be used to target proteins of the present disclosure to a target nucleic acid. One of the simplest systems is the type II CRISPR system from *Streptococcus pyogenes*. Only a single gene encoding the CAS9 protein and two RNAs, a mature CRISPR RNA (crRNA) and a partially complementary trans-acting RNA (tracrRNA), are necessary and sufficient for RNA-guided silencing of foreign DNAs (Jinek et al., 2012). Maturation of crRNA requires tracrRNA and RNase III (Deltcheva et al., 2011). However, this requirement can be bypassed by using an engineered small guide RNA (gRNA) containing a designed hairpin that mimics the tracrRNA-crRNA complex (Jinek et al., 2012). Base pairing between the gRNA and target DNA normally causes double-strand breaks (DSBs) due to the endonuclease activity of CAS9.

It is known that the endonuclease domains of the CAS9 protein can be mutated to create a programmable RNA-dependent DNA-binding protein (dCAS9) (Qi et al., 2013). The fact that duplex gRNA-dCAS9 binds target sequences without endonuclease activity has been used to tether regulatory proteins, such as transcriptional activators or repressors, to promoter regions in order to modify gene expression (Gilbert et al., 2013), and CAS9 transcriptional activators have been used for target specificity screening and paired nickases for cooperative genome engineering (Mali et al., 2013, Nature Biotechnology 31:833-838). Thus, dCAS9 may be used as a modular RNA-guided platform to recruit different proteins to DNA in a highly specific manner. One of skill in the art would recognize other RNA-guided DNA binding protein/RNA complexes that can be used equivalently to CRISPR-CAS9.

The CRISPR-CAS9 system may be used to target an epigenetic regulator of the present disclosure such as, for example, one or more of an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPB4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein to a specific nucleic acid.

Targeting using CRISPR-CAS9 may be beneficial over other genome targeting techniques in certain instances. For example, one need only change the guide RNAs in order to target fusion proteins to a new genomic location, or even multiple locations simultaneously. Further, CAS9-mediated targeting has been shown to be insensitive to the methylation state of the target nucleic acid (Nature Biotechnology 31, 827-832 (2013)). In addition, guide RNAs can be extended to include sites for binding to proteins, such as the MS2 protein, which can be fused to proteins of interest.

CAS9 Proteins

A variety of CAS9 proteins may be used in the methods of the present disclosure. There are several CAS9 genes present in different bacteria species (Esvelt, K et al, 2013, Nature Methods). One of the most characterized CAS9 proteins is the CAS9 protein from *S. pyogenes* that, in order to be active, needs to bind a gRNA with a specific sequence and the presence of a PAM motif (NGG, where N is any nucleotide) at the 3' end of the target locus. However, other CAS9 proteins from different bacterial species show differences in 1) the sequence of the gRNA they can bind and 2) the sequence of the PAM motif. Therefore, it is possible that other CAS9 proteins such as, for example, those from *Streptococcus thermophilus* or *N. meningitidis* may also be utilized herein. Indeed, these two CAS9 proteins have a smaller size (around 1100 amino acids) as compared to *S. pyogenes* CAS9 (1400 amino acids), which may confer some advantages during cloning or protein expression.

CAS9 proteins from a variety of bacteria have been used successfully in engineered CRISPR-CAS9 systems. There are also versions of CAS9 proteins available in which the codon usage has been more highly optimized for expression in eukaryotic systems, such as human codon optimized CAS9 (Cell, 152:1173-1183) and plant optimized CAS9 (Nature Biotechnology, 31:688-691).

CAS9 proteins may also be modified for various purposes. For example, CAS9 proteins may be engineered to contain a nuclear-localization sequence (NLS). CAS9 proteins may be engineered to contain an NLS at the N-terminus of the protein, at the C-terminus of the protein, or at both the N- and C-terminus of the protein. Engineering a CAS9 protein to contain an NLS may assist with directing the protein to the nucleus of a host cell. CAS9 proteins may be engineered such that they are unable to cleave nucleic acids (e.g. nuclease-deficient dCAS9 polypeptides). One of skill in the art would be able to readily identify a suitable CAS9 protein for use in the methods and compositions of the present disclosure.

Exemplary CAS9 proteins that may be used in the methods and compositions of the present disclosure may include, for example, a CAS9 protein having the amino acid sequence of any one of SEQ ID NO: 401, SEQ ID NO: 402, and/or SEQ ID NO: 403, homologs thereof, and fragments thereof.

In some embodiments, a CAS9 polypeptide or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 401, SEQ ID NO: 402, or SEQ ID NO: 403. In some embodiments, the CAS9 polypeptide does not have nuclease activity and is unable to cleave a nucleic acid molecule (e.g. dCAS9 polypeptide).

CRISPR RNAs

The CRISPR RNA (crRNA) of the present disclosure may take a variety of forms. As described above, the sequence of the crRNA is involved in conferring specificity to targeting a specific nucleic acid.

Many different crRNA molecules can be designed to target many different sequences. With respect to targeting, target nucleic acids generally require the PAM sequence, NGG, at the end of the 20 base pair target sequence. crRNAs of the present disclosure may be expressed as a single crRNA molecule, or they may be expressed in the form of a crRNA/tracrRNA hybrid molecule where the crRNA and the tracrRNA have been fused together, forming a guide RNA (gRNA). crRNA molecules and/or guide RNA molecules may be extended to include sites for the binding of RNA binding proteins.

Multiple crRNAs and/or guide RNAs can be encoded into a single CRISPR array to enable simultaneous targeting to several sites (Science 2013: Vol. pp. 819-823). For example, the tracrRNA may be expressed separately, and two adjacent target sequences may be encoded in a pre-crRNA array interspaced with repeats.

A variety of promoters may be used to drive expression of the crRNA and/or the guide RNA. crRNAs and/or guide RNAs may be expressed using a Pol III promoter such as, for example, the U6 promoter or the H1 promoter (eLife 20132: e00471). For example, an approach in plants has been described using three different Pol III promoters from three different *Arabidopsis* U6 genes, and their corresponding gene terminators (BMC Plant Biology 2014 14:327). One skilled in the art would readily understand that many additional Pol III promoters could be utilized to simultaneously express many crRNAs and/or guide RNAs to many different locations in the genome simultaneously. The use of different Pol III promoters for each crRNA and/or gRNA expression cassette may be desirable to reduce the chances of natural gene silencing that can occur when multiple copies of identical sequences are expressed in plants. In addition, crRNAs and/or guide RNAs can be modified to improve the efficiency of their function in guiding CAS9 to a target nucleic acid. For example, it has been shown that adding either 8 or 20 additional nucleotides to the gRNA in order to extend the hairpin by 4 or 10 base pairs resulted in more efficient CAS9 activity (eLife 2013 2:e00471).

Alternatively, a tRNA-gRNA expression cassette (Xie, X et al, 2015, Proc Natl Acad Sci USA. 2015 Mar. 17; 112(11):3570-5) may be used to deliver multiple gRNAs simultaneously with high expression levels.

Trans-Activating CRISPR RNAs

The trans-activating CRISPR RNA (tracrRNA) of the present disclosure may take a variety of forms, as will be readily understood by one of skill in the art. As described above, tracrRNAs are involved in the maturation of a crRNA. tracrRNAs of the present disclosure may be expressed as a single tracrRNA molecule, or they may be expressed in the form of a crRNA/tracrRNA hybrid molecule where the crRNA and the tracrRNA have been fused together, forming a guide RNA (gRNA). tracrRNA molecules and/or guide RNA molecules may be extended to include sites for the binding of RNA binding proteins.

As CRISPR systems naturally exist in a variety of bacteria, the framework of the crRNA and tracrRNA in these bacteria may be adapted for use in the methods and compositions described herein. crRNAs, tracrRNAs, and/or guide RNAs of the present disclosure may be constructed based on the framework of one or more of these molecules in, for example, *S. pyogenes, Streptococcus thermophilus*, and/or *N. meningitidis*. For example, a guide RNA of the present disclosure may be constructed based on the framework of the crRNA and tracrRNA from *S. pyogenes* (SEQ ID NO: 404), *Streptococcus thermophilus* (SEQ ID NO: 405), and/or *N. meningitidis* (SEQ ID NO: 406). In these exemplary frameworks, the 5' end of the sequence contains 20 generic nucleotides (N) that correspond to the crRNA targeting sequence. This sequence will vary depending on the sequence of the particular nucleic acid being targeted.

Linkers

Various linkers may be used in the construction of recombinant proteins as described herein. In general, linkers are short peptides that separate the different domains in a multi-domain protein. They may play an important role in fusion proteins, affecting the crosstalk between the different domains, the yield of protein production, and the stability and/or the activity of the fusion proteins. Linkers are generally classified into 2 major categories: flexible or rigid. Flexible linkers are typically used when the fused domains require a certain degree of movement or interaction, and these linkers are usually composed of small amino acids such as, for example, glycine (G), serine (S) or proline (P).

The certain degree of movement between domains allowed by flexible linkers is an advantage in some fusion proteins. However, it has been reported that flexible linkers can sometimes reduce protein activity due to an inefficient separation of the two domains. In this case, rigid linkers may be used since they enforce a fixed distance between domains and promote their independent functions. A thorough description of several linkers has been provided in Chen X et al., 2013, Advanced Drug Delivery Reviews 65 (2013) 1357-1369).

Various linkers may be used in, for example, the construction of recombinant epigenetic regulators that are fused to a CAS9 protein as described herein. Linkers may be used in the epigenetic regulator-CAS9 fusion proteins described herein to separate the coding sequences of an epigenetic regulator of the present disclosure and a CAS9 protein. For example, a variety of wiggly/flexible linkers, stiff/rigid linkers, short linkers, and long linkers may be used as described herein. Various linkers as described herein may be used in the construction of one or more SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins as described herein. Linkers may also be used in other recombinant polypeptides as described herein (e.g. recombinant polypeptides in a SunTag system).

A variety of shorter or longer linker regions are known in the art, for example corresponding to a series of glycine residues, a series of adjacent glycine-serine dipeptides, a series of adjacent glycine-glycine-serine tripeptides, or known linkers from other proteins. A flexible linker may include, for example, the amino acid sequence: SSGPPPGTG (SEQ ID NO: 411) and variants thereof. A rigid linker may include, for example, the amino acid sequence: AEAAAKEAAAKA (SEQ ID NO: 863) and variants thereof. The XTEN linker, SGSETPGTSESATPES (SEQ ID NO: 864), and variants thereof, described in Guilinget et al, 2014 (*Nature Biotechnology* 32, 577-582), may also be used. This particular linker was previously shown to produce the best results among other linkers in a protein fusion between dCAS9 and the nuclease FokI.

Variations of CRISPR-CAS9 Targeting

Certain aspects of the present disclosure relate to recombinantly fusing a polypeptide of the present disclosure such as, for example, an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, a RDM1 protein, a DRM3 protein, a DRM2 protein, a DRM2 protein, and/or a FRG protein to a CAS9 protein. However, CRISPR-CAS9 targeting schemes as described herein to target a specific nucleic acid may also involve schemes where a polypeptide of the present disclosure is targeted to a specific nucleic acid without being recombinantly fused to a CAS9 protein.

The use of recombinant proteins containing an epigenetic regulator recombinantly fused to an RNA-binding protein may be used in targeting of the epigenetic regulator to a specific nucleic acid via CRISPR-CAS9 targeting. In some embodiments, an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, a RDM1 protein, a DRM3 protein, a DRM2 protein, and/or a FRG protein is recombinantly fused to an MS2 coat protein such that these fusion proteins may be directed to a target nucleic acid with the assistance of a CAS9 protein. Various MS2 coat proteins may be used, such as SEQ ID NO. 407 and homologs thereof. This targeting scheme is further described herein and will be readily understood by one of skill in the art in view of the present disclosure.

In addition to fusing an epigenetic regulator to an MS2 coat protein, other RNA-binding proteins may also be used in this targeting scheme. For example, the proteins PP7 and COM (Zalatan et al., Cell 160, 339-350), may also be recombinantly fused to an SHH1 protein, an SHH2 protein, an AGO4 protein, an HDA6 protein, an NRPD1 protein, an NRPE1 protein, a JMJ14 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, a RDM1 protein, a DRM3 protein, a DRM2 protein, and/or a FRG protein such that these fusion proteins may be directed to a target nucleic acid with the assistance of a CAS9 protein.

The use of recombinant proteins containing an epigenetic regulator recombinantly fused to an antibody or fragment thereof may be used in targeting of the epigenetic regulator to a specific nucleic acid via CRISPR-CAS9 targeting. In some embodiments, an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein is recombinantly fused to an scFV antibody such that these fusion proteins may be directed to a target nucleic acid with the assistance of a CAS9 protein. Various scFV antibodies may be used, such as SEQ ID NO: 408 and homologs thereof. This targeting scheme is further described herein and will be readily understood by one of skill in the art in view of the present disclosure.

Similar systems using antibody mimetic proteins or proteins which can bind other proteins may also be used in the methods described herein. For example, designed ankyrin repeat proteins (DARPins), which are small and highly stable proteins that can bind their epitopes with strong affinity (Binz et al., 2004, Nat. Biotechnol. 22, 575-582), may be recombinantly fused to an SHH1 protein, an SHH2 protein, an AGO4 protein, an HDA6 protein, an NRPD1 protein, an NRPE1 protein, a JMJ14 protein, an RDR2 protein, an NRPD2A/NRPE2 protein, an NRPB3/NRPD3/NRPE3A protein, an NRPE3B protein, an NRPB11/NRPD11/NRPE11 protein, an NRPB10/NRPD10/NRPE10 protein, an NRPB12/NRPD12/NRPE12 protein, an NRPB6A/NRPD6A/NRPE6A protein, an NRPB6B/NRPD6B/NRPE6B protein, an NRPB8A/NRPE8A protein, an NRPB8B/NRPD8B/NRPE8B protein, an NRPE5 protein, an NRPD4/NRPE4 protein, an NRPE7 protein, an NRPD7 protein, an NRPB5/NRPD5 protein, an NRPB9A/NRPD9A/NRPE9A protein, an NRPB9B/NRPD9B/NRPE9B protein, an ATRX protein, a MOM1 protein, a MORC1 protein, an SssI protein, a DRM2-MTase protein, a DNMT3A protein, a DNMT3L protein, a MBD9 protein, a SUVH2 protein, a SUVH9 protein, a DMS3 protein, a MORC6 protein, a SUVR2 protein, a DRD1 protein, an RDM1 protein, a DRM3 protein, a DRM2 protein, and/or an FRG protein such that these fusion proteins may be directed to a target nucleic acid with the assistance of a CAS9 protein.

SunTag Systems

Certain aspects of the present disclosure relate to the use of SunTag systems for targeting (using CRISPR-based targeting) an epigenetic regulator of the present disclosure to a target nucleic acid. A synthetic system was previously developed for use in mammals for recruiting multiple copies of a protein to a target polypeptide chain, and this system was called a SunTag system (Tanenbaum et al., 2014) (WO2016011070). This system was also adapted so that the multiple copies of the protein using the SunTag system could be targeted to a nucleic acid using the CRISPR-Cas9 system (Tanenbaum et al., 2014). However, this system was developed for use in mammals. Provided herein are methods and compositions for SunTag systems adapted to target epigenetic regulators to specific loci in plants.

Accordingly, the present disclosure provides methods and compositions for the recruitment of multiple copies of an epigenetic regulator (e.g. DRM2-MTase, DNMT3A, DNMT3L, DNMT3A-DNMT3L polypeptide fusions) to a target nucleic acid in plants via CRISPR-based targeting in a manner that allows for methylation and/or silencing of the target nucleic acid. In certain aspects, this specific targeting involves the use of a system that includes (1) a nuclease-deficient CAS9 polypeptide that is recombinantly fused to a multimerized epitope, (2) an epigenetic regulator polypeptide (e.g. DRM2-MTase, DNMT3A, DNMT3L, DNMT3A-DNMT3L polypeptide fusions) that is recombinantly fused to an affinity polypeptide, and (3) a guide RNA (gRNA). In this aspect, the dCAS9 portion of the dCAS9-multimerized epitope fusion protein is involved with targeting a target nucleic acid as directed by the guide RNA. The multimerized epitope portion of the dCAS9-multimerized epitope fusion protein is involved with binding to the affinity polypeptide (which is recombinantly fused to an epigenetic regulator). The affinity polypeptide portion of the epigenetic regulator-affinity polypeptide fusion protein is involved with binding to the multimerized epitope so that the epigenetic regulator can be in association with dCAS9. The epigenetic regulator portion of the epigenetic regulator-affinity polypeptide fusion protein is involved with inducing methylation and/or silencing of a target nucleic acid, once the complex has been targeted to a target nucleic acid via the guide RNA.

As described above, SunTag systems involve targeting based on CRISPR-CAS9 systems. CRISPR-CAS9 systems are described above. The features of CRISPR-CAS9 systems may be used in SunTag systems of the present disclosure as appropriate, as will be readily understood by one of skill in the art.

Affinity Polypeptides

Certain aspects of the present disclosure relate to recombinant polypeptides that contain an affinity polypeptide. Affinity polypeptides of the present disclosure may bind to one or more epitopes (e.g. a multimerized epitope). In some embodiments, an affinity polypeptide is present in a recombinant polypeptide that contains an epigenetic regulator polypeptide (e.g. DRM2-MTase, DNMT3A, DNMT3L, DNMT3A-DNMT3L polypeptide fusions) and an affinity polypeptide.

A variety of affinity polypeptides are known in the art and may be used herein. Generally, the affinity polypeptide should be stable in the conditions present in the intracellular environment of a plant cell. Additionally, the affinity polypeptide should specifically bind to its corresponding epitope with minimal cross-reactivity.

The affinity polypeptide may be an antibody such as, for example, an scFv. The antibody may be optimized for stability in the plant intracellular environment. When a GCN4 epitope is used in the methods described herein, a suitable affinity polypeptide that is an antibody may contain an anti-GCN4 scFv domain.

In embodiments where the affinity polypeptide is an scFv antibody, the polypeptide may contain an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 793.

Other exemplary affinity polypeptides include, for example, proteins with SH2 domains or the domain itself, 14-3-3 proteins, proteins with SH3 domains or the domain itself, the Alpha-Syntrophin PDZ protein interaction domain, the PDZ signal sequence, or proteins from plants which can recognize AGO hook motifs (e.g. AGO4 from *Arabidopsis thaliana*).

Additional affinity polypeptides that may be used in the methods and compositions described herein will be readily apparent to those of skill in the art.

Epitopes and Multimerized Epitopes

Certain aspects of the present disclosure relate to recombinant polypeptides that contain an epitope or a multimerized epitope. Epitopes of the present disclosure may bind to an affinity polypeptide. In some embodiments, an epitope or multimerized epitope is present in a recombinant polypeptide that contains dCAS9 polypeptide.

Epitopes of the present disclosure may be used for recruiting affinity polypeptides (and any polypeptides they may be recombinantly fused to) to a dCAS9 polypeptide. In embodiments where a dCAS9 polypeptide is fused to an epitope or a multimerized epitope, the dCAS9 polypeptide may be fused to one copy of an epitope, multiple copies of an epitope, more than one different epitope, or multiple copies of more than one different epitope as further described herein.

A variety of epitopes and multimerized epitopes are known in the art and may be used herein. In general, the epitope or multimerized epitope may be any polypeptide sequence that is specifically recognized by an affinity polypeptide of the present disclosure. Exemplary epitopes may include a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, a VSV-G epitope, and a GCN4 epitope.

Other exemplary amino acid sequences that may serve as epitopes and multimerized epitopes include, for example, phosphorylated tyrosines in specific sequence contexts recognized by SH2 domains, characteristic consensus sequences containing phosphoserines recognized by 14-3-3 proteins, proline rich peptide motifs recognized by SH3 domains, the PDZ protein interaction domain or the PDZ signal sequence, and the AGO hook motif from plants.

Epitopes described herein may also be multimerized. Multimerized epitopes may include at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or at least 24 or more copies of an epitope.

Multimerized epitopes may be present as tandem copies of an epitope, or each individual epitope may be separated from another epitope in the multimerized epitope by a linker or other amino acid sequence. Suitable linker regions are known in the art and are described herein. The linker may be configured to allow the binding of affinity polypeptides to adjacent epitopes without, or without substantial, steric hindrance. Linker sequences may also be configured to provide an unstructured or linear region of the polypeptide to which they are recombinantly fused. The linker sequence may comprise e.g. one or more glycines and/or serines. The linker sequences may be e.g. at least 2, at least 3, at least 4, at least 5, at least 6, at least 7, at least 8, at least 9, or at least 10 or more amino acids in length.

In some embodiments, the epitope is a GCN4 epitope (SEQ ID NO: 806). In some embodiments, the multimerized epitope contains at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or at least 24 copies of a GCN4 epitope. In some embodiments, the multimerized epitope contains 10 copies of a GCN4 epitope.

Additional epitopes and multimerized epitopes that may be used in the methods and compositions described herein will be readily apparent to those of skill in the art.

Recombinant Proteins of the Present Disclosure

Certain methods of the present disclosure relate to reducing the expression of a target nucleic acid in a plant by recombinantly fusing an epigenetic regulator polypeptide to a heterologous DNA-binding domain, where the DNA-binding domain is able to bind a specific nucleic acid sequence and thus the epigenetic regulator is targeted to the specific nucleic acid sequence. Certain methods of the present disclosure relate to reducing the expression of a target nucleic acid in a plant by targeting an epigenetic regulator recombinantly fused to a CAS9 protein to the target nucleic acid. Certain methods of the present disclosure relate to reducing the expression of a target nucleic acid in a plant by targeting a recombinant epigenetic regulator to a target nucleic acid with the assistance of a CAS9 protein. As used herein, a "polypeptide" is an amino acid sequence including a plurality of consecutive polymerized amino acid residues (e.g., at least about 15 consecutive polymerized amino acid residues). "Polypeptide" refers to an amino acid sequence, oligopeptide, peptide, protein, or portions thereof, and the terms "polypeptide" and "protein" are used interchangeably.

Accordingly, provided herein are recombinant proteins for use in reducing the expression of a target nucleic acid in a plant. In some embodiments, a recombinant protein of the present disclosure interacts with an RNA polymerase. This interaction may be direct or it may be indirect. Whether the interaction of a recombinant protein of the present disclosure with an RNA polymerase is direct or indirect, and without wishing to be bound by theory, it is though that the interaction facilitates the recruitment of the RNA polymerase to a nucleic acid. In some embodiments, one or more additional proteins may be further involved in facilitating the interaction of a recombinant protein of the present disclosure with an RNA polymerase and recruitment of the RNA polymerase to a nucleic acid. In some embodiments, a recombinant protein of the present disclosure may interact, directly or indirectly, with RNA Pol IV and this interaction facilitates the recruitment of RNA Pol IV to a nucleic acid. In some embodiments, a recombinant protein of the present disclosure may interact, directly or indirectly, with RNA Pol V and this interaction facilitates the recruitment of RNA Pol V to a nucleic acid. In some embodiments, the recombinant proteins of the present disclosure facilitate RNA-directed DNA methylation of a nucleic acid.

In some embodiments, recombinant proteins of the present disclosure such as, for example, SHH1-like proteins, SHH2-like proteins, AGO4-like proteins, HDA6-like proteins, NRPD1-like proteins, JMJ14-like proteins, RDR2-like proteins, NRPE1-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins are targeted to the same nucleic acid and cooperatively act to silence the expression of the target nucleic acid. Recombinant proteins of the present disclosure may be recombinantly expressed in a cell either alone or in combinations.

Polypeptides as described herein also include polypeptides having various amino acid additions, deletions, or substitutions relative to the native amino acid sequence of a polypeptide of the present disclosure. In some embodiments, polypeptides that are homologs of a polypeptide of the present disclosure contain non-conservative changes of certain amino acids relative to the native sequence of a polypeptide of the present disclosure. In some embodiments, polypeptides that are homologs of a polypeptide of the present disclosure contain conservative changes of certain amino acids relative to the native sequence of a polypeptide of the present disclosure, and thus may be referred to as conservatively modified variants. A conservatively modified variant may include individual substitutions, deletions or additions to a polypeptide sequence which result in the substitution of an amino acid with a chemically similar amino acid. Conservative substitution tables providing functionally similar amino acids are well-known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)). A modification of an amino acid to produce a chemically similar amino acid may be referred to as an analogous amino acid.

Recombinant polypeptides of the present disclosure that are composed of individual polypeptide domains may be described based on the individual polypeptide domains of the overall recombinant polypeptide. A domain in such a recombinant polypeptide refers to the particular stretches of contiguous amino acid sequences with a particular function or activity. For example, in a recombinant polypeptide that is a fusion of an epigenetic regulator polypeptide and an affinity polypeptide, the contiguous amino acids that encode the epigenetic regulator polypeptide may be described as the epigenetic regulator domain in the overall recombinant polypeptide, and the contiguous amino acids that encode the affinity polypeptide may be described as the affinity domain in the overall recombinant polypeptide. Individual domains in an overall recombinant protein may also be referred to as units of the recombinant protein. Recombinant polypeptides that are composed of individual polypeptide domains may also be referred to as fusion polypeptides.

Fusion polypeptides of the present disclosure may contain an individual polypeptide domain that is in various N-terminal or C-terminal orientations relative to other individual polypeptide domains present in the fusion polypeptide. Fusion of individual polypeptide domains in fusion polypeptides may also be direct or indirect fusions. Direct fusions of individual polypeptide domains refer to direct fusion of the coding sequences of each respective individual polypeptide domain. In embodiments where the fusion is indirect, a linker domain or other contiguous amino acid sequence may separate the coding sequences of two individual polypeptide domains in a fusion polypeptide.

Nuclear Localization Signals (NLS)

Recombinant polypeptides of the present disclosure may contain one or more nuclear localization signals (NLS). Nuclear localization signals may also be referred to as nuclear localization sequences, domains, peptides, or other terms readily apparent to those of skill in the art. Nuclear localization signals are a translocation sequence that, when present in a polypeptide, direct that polypeptide to localize to the nucleus of a eukaryotic cell.

Various nuclear localization signals may be used in recombinant polypeptides of the present disclosure. For example, one or more SV40-type NLS or one or more REX NLS may be used in recombinant polypeptides. Recombinant polypeptides may also contain two or more tandem copies of a nuclear localization signal. For example, recombinant polypeptides may contain at least two, at least three, at least for, at least five, at least six, at least seven, at least eight, at least nine, or at least ten copies, either tandem or not, of a nuclear localization signal.

Recombinant polypeptides of the present disclosure may contain one or more nuclear localization signals that contain an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of any one of SEQ ID NO: 779, SEQ ID NO: 797, and/or SEQ ID NO: 799.

SHH1 Proteins

Certain aspects of the present disclosure relate to SHH1-like proteins. In some embodiments, an SHH1-like protein refers to a recombinant SHH1 protein or fragment thereof that contains a heterologous DNA-binding domain. In some embodiments, an SHH1-like protein refers to a recombinant SHH1 protein or fragment thereof that is fused to a CAS9 protein or fragment thereof. In some embodiments, an SHH1-like protein refers to a recombinant SHH1 protein or fragment thereof that is fused to an MS2 coat protein or fragment thereof. In some embodiments, an SHH1-like protein refers to a recombinant SHH1 protein or fragment thereof that is fused to an scFV antibody or fragment thereof. SHH1-like proteins may be used in reducing the expression of one or more target nucleic acids, such as genes, in plants.

SHH1 proteins of the present disclosure are SAWADEE HOMEODOMAIN HOMOLOG 1 (SHH1) proteins. Full-length SHH1 proteins contain a homeodomain and a chromatin-binding SAWADEE domain. The SAWADEE chromatin-binding domain adopts a unique tandem Tudor-like fold and functions as a dual lysine reader, probing for both unmethylated K4 and methylated K9 modifications on the histone 3 (H3) tail.

It was previously demonstrated that SHH1 is a chromatin-binding protein that functions in RdDM to enable Pol-IV recruitment and/or stability at the most actively targeted genomic loci in order to promote siRNA biogenesis (See WO/2014/134567, which is incorporated herein by reference in its entirety). Without wishing to be bound by theory, it is believed that the finding that SHH1 binds to repressive histone modifications, together with the observation that SHH1 is required for Pol IV chromatin association at a similar set of loci as downstream RdDM mutants, could explain the previously observed self-reinforcing loop in which downstream RdDM mutants are required for the production of full levels of siRNAs from a subset of genomic loci (Zilberman et al., 2004; Xie et al., 2004; Li et al., 2006; Pontes et al., 2006) as it has been shown that downstream RdDM mutants can cause a reduction of both DNA methylation and H3K9 methylation at RdDM loci (Zilberman et al., 2003).

In some embodiments, SHH1-like proteins of the present disclosure are chromatin-binding proteins. In some embodiments, an SHH1-like protein of the present disclosure includes a functional fragment of a full-length SHH1 protein where the fragment maintains the ability to recruit RNA Pol IV to DNA. In some embodiments, an SHH1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SHH1 protein. In some embodiments, SHH1 protein fragments may include sequences with one or more amino acids removed from the consecutive amino acid sequence of a full-length SHH1 protein. In some embodiments, SHH1 protein fragments may include sequences with one or more amino acids replaced/substituted with an amino acid different from the endogenous amino acid present at a given amino acid position in a consecutive amino acid sequence of a full-length SHH1 protein. In some embodiments, SHH1 protein fragments may include sequences with one or more amino acids added to an otherwise consecutive amino acid sequence of a full-length SHH1 protein.

Suitable SHH1 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable SHH1 proteins may include, for example, those listed in Table 1, homologs thereof, and orthologs thereof.

TABLE 1

SHH1 Proteins

| Organism | Gene Name | SED ID NO. |
|---|---|---|
| *Arabidopsis thaliana* | NP_849666.2 | 1 |
| *Ricinus communis* | XP_002515974.1 | 2 |
| *Glycine max* | XP_003531650.1 | 3 |
| *Zea mays* | NP_001141052.1 | 4 |
| *Medicago truncatula* | AFK39040.1 | 5 |
| *Physcomitrella patens* | XP_001760710.1 | 6 |
| *Sorghum bicolor* | XP_002462170.1 | 7 |
| *Oryza sativa* | NP_001062942.1 | 8 |
| *Brachypodium distachyon* | XP_003563870.1 | 9 |
| *Populus trichocarpa* | XP_002299736.1 | 10 |
| *Vitis vinifera* | XP_002283948.1 | 11 |
| *Cucumis sativus* | XP_004155951.1 | 12 |
| *Arabidopsis lyrata* | XP_002890094.1 | 13 |

In some embodiments, an SHH1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SHH1 protein (SEQ ID NO: 1).

An SHH1-like protein may include the amino acid sequence or a fragment thereof of any SHH1 homolog or ortholog, such as any one of those listed in Table 1. One of skill would readily recognize that additional SHH1 homologs and/or orthologs may exist and may be used herein.

SHH2 Proteins

Certain aspects of the present disclosure relate to SHH2-like proteins. In some embodiments, an SHH2-like protein refers to a recombinant SHH2 protein or fragment thereof that contains a heterologous DNA-binding domain. In some embodiments, an SHH2-like protein refers to a recombinant SHH2 protein or fragment thereof that is fused to a CAS9 protein or fragment thereof. In some embodiments, an SHH2-like protein refers to a recombinant SHH2 protein or fragment thereof that is fused to an MS2 coat protein or fragment thereof. In some embodiments, an SHH2-like protein refers to a recombinant SHH2 protein or fragment thereof that is fused to an scFV antibody or fragment thereof. SHH2-like proteins may be used in reducing the expression of one or more target nucleic acids, such as genes, in plants.

SHH2 is a homolog of SHH1 as described above. In some embodiments, SHH2-like proteins of the present disclosure are chromatin-binding proteins. In some embodiments, an SHH2-like protein of the present disclosure includes a functional fragment of a full-length SHH2 protein where the fragment maintains the ability to recruit RNA Pol IV to DNA. In some embodiments, an SHH2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SHH2 protein. In some embodiments, SHH2 protein fragments may include sequences with one or more amino acids removed from the consecutive amino acid sequence of a full-length SHH2 protein. In some embodiments, SHH2 protein fragments may include sequences with one or more amino acids replaced/substituted with an amino acid different from the endogenous amino acid present at a given amino acid position in a consecutive amino acid sequence of a full-length SHH2 protein. In some embodiments, SHH2 protein fragments may include sequences with one or more amino acids added to an otherwise consecutive amino acid sequence of a full-length SHH2 protein.

Suitable SHH2 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable SHH2 proteins may include, for example, those listed in Table 2, homologs thereof, and orthologs thereof.

TABLE 2

SHH2 Proteins

| Organism | Gene Name | SED ID NO. |
|---|---|---|
| *Arabidopsis thaliana* | AEE76089 | 14 |

In some embodiments, an SHH2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SHH2 protein (SEQ ID NO: 14). Suitable SHH2 proteins may also include homologous SHH1 proteins, such as those described in Table 1.

An SHH2-like protein may include the amino acid sequence or a fragment thereof of any SHH2 homolog or ortholog, such as any one of those listed in Table 2. One of skill would readily recognize that additional SHH2 homologs and/or orthologs may exist and may be used herein.

AGO4 Proteins

Certain aspects of the present disclosure relate to AGO4-like proteins. In some embodiments, an AGO4-like protein refers to a recombinant AGO4 protein or fragment thereof and that contains a heterologous DNA-binding domain. In some embodiments, an AGO4-like protein refers to a recombinant AGO4 protein or fragment thereof that is fused to a CAS9 protein or fragment thereof. In some embodiments, an AGO4-like protein refers to a recombinant AGO4 protein or fragment thereof that is fused to an MS2 coat protein or fragment thereof. In some embodiments, an AGO4-like protein refers to a recombinant AGO4 protein or fragment thereof that is fused to an scFV antibody or fragment thereof. AGO4-like proteins may be used in reducing the expression of one or more target nucleic acids, such as genes, in plants.

AGO4 proteins are known in the art and are described herein. In some embodiments, an AGO4 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length AGO4 protein. In some embodiments, AGO4 protein fragments may include sequences with one or more amino acids removed from the consecutive amino acid sequence of a full-length AGO4 protein. In some embodiments, AGO4 protein fragments may include sequences with one or more amino acids replaced/substituted with an amino acid different from the endogenous amino acid present at a given amino acid position in a consecutive amino acid sequence of a full-length AGO4 protein. In some embodiments, AGO4 protein fragments may include sequences with one or more amino acids added to an otherwise consecutive amino acid sequence of a full-length AGO4 protein.

Suitable AGO4 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable AGO4 proteins may include, for example, those listed in Table 3, homologs thereof, and orthologs thereof.

TABLE 3

AGO4 Proteins

| Organism | Gene Name | SED ID NO. |
|---|---|---|
| *Arabidopsis thaliana* | Q9ZVD5 | 15 |
| *Arabidopsis lyrata* | XP_002880875 | 16 |
| *Cucumis sativus* | XP_011653531 | 17 |
| *Vitis vinifera* | XP_002275928 | 18 |
| *Medicago truncatula* | XP_003617095 | 19 |
| *Ricinus communis* | XP_002527764 | 20 |
| *Glycine max* | XP_003545462 | 21 |
| *Zea mays* | NP_001167850 | 22 |
| *Sorghum bicolor* | XP_002440386 | 23 |
| *Oryza sativa* | NP_001052115 | 24 |
| *Brachypodium distachyon* | XP_010230772 | 25 |
| *Populus trichocarpa* | XP_006369390 | 26 |
| *Brassica napus* | CDX77061 | 27 |

In some embodiments, an AGO4 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* AGO4 protein (SEQ ID NO: 15).

An AGO4-like protein may include the amino acid sequence or a fragment thereof of any AGO4 homolog or ortholog, such as any one of those listed in Table 3. One of skill would readily recognize that additional AGO4 homologs and/or orthologs may exist and may be used herein.

AGO4 is a PAZ/PIWI domain-containing protein that belongs to a clade of proteins that includes e.g. AGO6 and AGO9. Exemplary proteins in this clade, using *A. thaliana* as an exemplary host plant, include, for example, AGO6 (SEQ ID NO: 363) and AGO9 (SEQ ID NO: 364). An alignment of various proteins in this clade from *A. thaliana* is provided in FIG. 1. The proteins in this clade, as well as homologs and orthologs thereof, may also be used in the methods and compositions of the present disclosure to target and silence a specific nucleic acid as described herein for AGO4-like proteins. AGO3 (SEQ ID NO: 503), as well as homologs and orthologs thereof, may also be used in the methods and compositions of the present disclosure to target and silence a specific nucleic acid as described herein for AGO4-like proteins.

HDA6 Proteins

Certain aspects of the present disclosure relate to HDA6-like proteins. In some embodiments, an HDA6-like protein refers to a recombinant HDA6 protein or fragment thereof and that contains a heterologous DNA-binding domain. In some embodiments, an HDA6-like protein refers to a recombinant HDA6 protein or fragment thereof that is fused to a CAS9 protein or fragment thereof. In some embodiments, an HDA6-like protein refers to a recombinant HDA6 protein or fragment thereof that is fused to an MS2 coat protein or fragment thereof. In some embodiments, an HDA6-like protein refers to a recombinant HDA6 protein or fragment thereof that is fused to an scFV antibody or fragment thereof. HDA6-like proteins may be used in reducing the expression of one or more target nucleic acids, such as genes, in plants.

HDA6 proteins are known in the art and are described herein. In some embodiments, an HDA6 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length HDA6 protein. In some embodiments, HDA6 protein fragments may include sequences with one or more amino acids removed from the consecutive amino acid sequence of a full-length HDA6 protein. In some embodiments, HDA6 protein fragments may include sequences with one or more amino acids replaced/substituted with an amino acid different from the endogenous amino acid present at a given amino acid position in a consecutive amino acid sequence of a full-length HDA6 protein. In some embodiments, HDA6 protein fragments may include sequences with one or more amino acids added to an otherwise consecutive amino acid sequence of a full-length HDA6 protein.

Suitable HDA6 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable HDA6 proteins may include, for example, those listed in Table 4, homologs thereof, and orthologs thereof.

TABLE 4

HDA6 Proteins

| Organism | Gene Name | SED ID NO. |
|---|---|---|
| *Arabidopsis thaliana* | Q9FML2 | 28 |
| *Arabidopsis lyrata* | XP_002866535 | 29 |
| *Cucumis sativus* | XP_004138094 | 30 |
| *Vitis vinifera* | XP_010663108 | 31 |
| *Medicago truncatula* | XP_003601202 | 32 |
| *Ricinus communis* | XP_002511337 | 33 |
| *Glycine max* | XP_003525556 | 34 |
| *Zea mays* | NP_001104901 | 35 |
| *Sorghum bicolor* | XP_002444249 | 36 |
| *Oryza sativa* | NP_001061596 | 37 |
| *Brachypodium distachyon* | XP_003573796 | 38 |
| *Populus trichocarpa* | XP_002322192 | 39 |
| *Brassica napus* | CDX84385 | 40 |

In some embodiments, an HDA6 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* HDA6 protein (SEQ ID NO: 28).

An HDA6-like protein may include the amino acid sequence or a fragment thereof of any HDA6 homolog or ortholog, such as any one of those listed in Table 4. One of skill would readily recognize that additional HDA6 homologs and/or orthologs may exist and may be used herein.

HDA6 is a histone deacetylase that belongs to a clade of proteins that includes e.g. HDA1, HDA7, and HDA9. Exemplary proteins in this clade, using *A. thaliana* as an exemplary host plant, include, for example, HDA1 (SEQ ID NO: 365), HDA7 (SEQ ID NO: 366), HDA9 (SEQ ID NO: 367), HDA15 (SEQ ID NO: 369), and HDA14 (SEQ ID NO: 370). An alignment of various proteins in this clade from *A. thaliana* is provided in FIG. 2. The proteins in this clade, as well as homologs and orthologs thereof, may also be used in the methods and compositions of the present disclosure to target and silence a specific nucleic acid as described herein for HDA6-like proteins.

NRPD1 Proteins

Certain aspects of the present disclosure relate to NRPD1-like proteins. In some embodiments, an NRPD1-like protein refers to a recombinant NRPD1 protein or fragment thereof and that contains a heterologous DNA-binding domain. In some embodiments, an NRPD1-like protein refers to a recombinant NRPD1 protein or fragment thereof that is fused to a CAS9 protein or fragment thereof. In some embodiments, an NRPD1-like protein refers to a recombinant NRPD1 protein or fragment thereof that is fused to an MS2 coat protein or fragment thereof. In some embodiments, an NRPD1-like protein refers to a recombinant NRPD1 protein or fragment thereof that is fused to an scFV antibody or fragment thereof. NRPD1-like proteins may be used in reducing the expression of one or more target nucleic acids, such as genes, in plants.

NRPD1 proteins are known in the art and are described herein. NRPD1 proteins encode a large subunit of RNA Pol IV. In some embodiments, an NRPD1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPD1 protein. In some embodiments, NRPD1 protein fragments may include sequences with one or more amino acids removed from the consecutive amino acid sequence of a full-length NRPD1 protein. In some embodiments, NRPD1 protein fragments may include sequences with one or more amino acids replaced/substituted with an amino acid different from the endogenous amino acid present at a given amino acid position in a consecutive amino acid sequence of a full-length NRPD1 protein. In some embodiments, NRPD1 protein fragments may include sequences with one or more amino acids added to an otherwise consecutive amino acid sequence of a full-length NRPD1 protein.

Suitable NRPD1 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPD1 proteins may include, for example, those listed in Table 5, homologs thereof, and orthologs thereof.

TABLE 5

NRPD1 Proteins

| Organism | Gene Name | SED ID NO. |
|---|---|---|
| *Arabidopsis thaliana* | Q9LQ02 | 41 |
| *Arabidopsis lyrata* | XP_002886441.1 | 42 |
| *Cucumis sativus* | XP_004147993 | 43 |
| *Vitis vinifera* | XP_010661369.1 | 44 |
| *Medicago truncatula* | AES94122.2 | 45 |
| *Ricinus communis* | XP_002509696.1 | 46 |
| *Glycine max* | XP_006573754.1 | 47 |
| *Zea mays* | NP_001182824.1 | 48 |
| *Sorghum bicolor* | XP_002446962 | 49 |
| *Oryza sativa* | EEE61535 | 50 |
| *Brachypodium distachyon* | XP_003566523.1 | 51 |
| *Populus trichocarpa* | XP_002298071.2 | 52 |
| *Brassica napus* | CDY32191 | 53 |

In some embodiments, an NRPD1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPD1 protein (SEQ ID NO: 41).

An NRPD1-like protein may include the amino acid sequence or a fragment thereof of any NRPD1 homolog or ortholog, such as any one of those listed in Table 5. One of skill would readily recognize that additional NRPD1 homologs and/or orthologs may exist and may be used herein.

NRPE1 Proteins

Certain aspects of the present disclosure relate to NRPE1-like proteins. In some embodiments, an NRPE1-like protein refers to a recombinant NRPE1 protein or fragment thereof and that contains a heterologous DNA-binding domain. In some embodiments, an NRPE1-like protein refers to a recombinant NRPE1 protein or fragment thereof that is fused to a CAS9 protein or fragment thereof. In some embodiments, an NRPE1-like protein refers to a recombinant NRPE1 protein or fragment thereof that is fused to an MS2 coat protein or fragment thereof. In some embodiments, an NRPE1-like protein refers to a recombinant NRPE1 protein or fragment thereof that is fused to an scFV antibody or fragment thereof. NRPE1-like proteins may be used in reducing the expression of one or more target nucleic acids, such as genes, in plants.

NRPE1 proteins are known in the art and are described herein. NRPE1 proteins encode a large subunit of RNA Pol V. In some embodiments, an NRPE1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPE1 protein. In some embodiments, NRPE1 protein fragments may include sequences with one or more amino acids removed from the consecutive amino acid sequence of a full-length NRPE1 protein. In some embodiments, NRPE1 protein fragments may include sequences with one or more amino acids replaced/substituted with an amino acid different from the endogenous amino acid present at a given amino acid position in a consecutive amino acid sequence of a full-length NRPE1 protein. In some embodiments, NRPE1 protein fragments may include sequences with one or more amino acids added to an otherwise consecutive amino acid sequence of a full-length NRPE1 protein.

Suitable NRPE1 proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable NRPE1 proteins may include, for example, those listed in Table 6, homologs thereof, and orthologs thereof.

TABLE 6

NRPE1 Proteins

| Organism | Gene Name | SEQ ID NO. |
|---|---|---|
| Arabidopsis thaliana | Q5D869 | 54 |
| Arabidopsis lyrata | XP_002879839.1 | 55 |
| Cucumis sativus | XP_004155767.1 | 56 |
| Vitis vinifera | CBI40152.3 | 57 |
| Medicago truncatula | AET02314.2 | 58 |
| Ricinus communis | XP_002513060 | 59 |
| Glycine max | XP_006598109.1 | 60 |
| Zea mays | XP_008679943 | 61 |
| Sorghum bicolor | XP_002459158.1 | 62 |
| Oryza sativa | EEE56320 | 63 |
| Brachypodium distachyon | XP_010238829 | 64 |
| Populus trichocarpa | XP_002303926 | 65 |
| Brassica napus | CDY60335 | 66 |

In some embodiments, an NRPE1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPE1 protein (SEQ ID NO: 54).

An NRPE1-like protein may include the amino acid sequence or a fragment thereof of any NRPE1 homolog or ortholog, such as any one of those listed in Table 6. One of skill would readily recognize that additional NRPE1 homologs and/or orthologs may exist and may be used herein.

In addition to the NRPE1 proteins, orthologs, and homologs described herein, NRPE1 proteins contain a domain known as the AGO hook, which is involved with binding AGO4 proteins. Exemplary sequences of the AGO hook, using *A. thaliana* as an exemplary host plant, include, for example, SEQ ID NO: 371. An exemplary polypeptide containing a 5× multimerized AGO-hook is presented in SEQ ID NO: 372. Proteins and protein fragments containing an AGO-hook sequence may also be used in the methods and compositions of the present disclosure to target and silence a specific nucleic acid as described herein for NRPE1-like proteins.

JMJ14 Proteins

Certain aspects of the present disclosure relate to JMJ14-like proteins. In some embodiments, a JMJ14-like protein refers to a recombinant JMJ14 protein or fragment thereof and that contains a heterologous DNA-binding domain. In some embodiments, a JMJ14-like protein refers to a recombinant JMJ14 protein or fragment thereof that is fused to a CAS9 protein or fragment thereof. In some embodiments, a JMJ14-like protein refers to a recombinant JMJ14 protein or fragment thereof that is fused to an MS2 coat protein or fragment thereof. In some embodiments, a JMJ14-like protein refers to a recombinant JMJ14 protein or fragment thereof that is fused to an scFV antibody or fragment thereof. JMJ14-like proteins may be used in reducing the expression of one or more target nucleic acids, such as genes, in plants.

JMJ14 proteins are known in the art and are described herein. In some embodiments, a JMJ14 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length JMJ14 protein. In some embodiments, JMJ14 protein fragments may include sequences with one or more amino acids removed from the consecutive amino acid sequence of a full-length JMJ14 protein. In some embodiments, JMJ14 protein fragments may include sequences with one or more amino acids replaced/substituted with an amino acid different from the endogenous amino acid present at a given amino acid position in a consecutive amino acid sequence of a full-length JMJ14 protein. In some embodiments, JMJ14 protein fragments may include sequences with one or more amino acids added to an otherwise consecutive amino acid sequence of a full-length JMJ14 protein.

Suitable JMJ14 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable JMJ14 proteins may include, for example, those listed in Table 7, homologs thereof, and orthologs thereof.

TABLE 7

JMJ14 Proteins

| Organism | Gene Name | SED ID NO. |
|---|---|---|
| Arabidopsis thaliana | Q8GUI6 | 80 |
| Arabidopsis lyrata | XP_002869932 | 81 |
| Cucumis sativus | XP_004135564 | 82 |
| Vitis vinifera | CBI39010 | 83 |
| Medicago truncatula | KEH37778 | 84 |
| Ricinus communis | XP_002529883 | 85 |
| Glycine max | XP_003535005 | 86 |
| Zea mays | XP_008648146 | 87 |
| Sorghum bicolor | XP_002454748 | 88 |
| Oryza sativa | EEE63155 | 89 |
| Brachypodium distachyon | XP_010235272 | 90 |
| Populus trichocarpa | XP_006370484 | 91 |
| Brassica napus | CDX82762 | 92 |

In some embodiments, a JMJ14 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* JMJ14 protein (SEQ ID NO: 80).

A JMJ14-like protein may include the amino acid sequence or a fragment thereof of any JMJ14 homolog or ortholog, such as any one of those listed in Table 7. One of skill would readily recognize that additional JMJ14 homologs and/or orthologs may exist and may be used herein.

JMJ14 is an H3K4 demethylase that belongs to a clade of proteins that includes e.g. JMJ18, JMJ15, and PKDM7D. Exemplary proteins in this clade, using *A. thaliana* as an exemplary host plant, include, for example, JMJ18 (SEQ ID NO: 376), JMJ15 (SEQ ID NO: 377), and PKDM7D (SEQ ID NO: 378). An alignment of various proteins in this clade from *A. thaliana* is provided in FIG. 3A-3B. The proteins in this clade, as well as homologs and orthologs thereof, may also be used in the methods and compositions of the present disclosure to target and silence a specific nucleic acid as described herein for JMJ14-like proteins.

RDR2 Proteins

Certain aspects of the present disclosure relate to RDR2-like proteins. In some embodiments, an RDR2-like protein refers to a recombinant RDR2 protein or fragment thereof and that contains a heterologous DNA-binding domain. In some embodiments, an RDR2-like protein refers to a recombinant RDR2 protein or fragment thereof that is fused to a CAS9 protein or fragment thereof. In some embodiments, an RDR2-like protein refers to a recombinant RDR2 protein or fragment thereof that is fused to an MS2 coat protein or fragment thereof. In some embodiments, an RDR2-like protein refers to a recombinant RDR2 protein or fragment thereof that is fused to an scFV antibody or fragment thereof. RDR2-like proteins may be used in reducing the expression of one or more target nucleic acids, such as genes, in plants.

RDR2 proteins are known in the art and are described herein. In some embodiments, a RDR2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length RDR2 protein. In some embodiments, RDR2 protein fragments may include sequences with one or more amino acids removed from the consecutive amino acid sequence of a full-length RDR2 protein. In some embodiments, RDR2 protein fragments may include sequences with one or more amino acids replaced/substituted with an amino acid different from the endogenous amino acid present at a given amino acid position in a consecutive amino acid sequence of a full-length RDR2 protein. In some embodiments, RDR2 protein fragments may include sequences with one or more amino acids added to an otherwise consecutive amino acid sequence of a full-length RDR2 protein.

Suitable RDR2 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable RDR2 proteins may include, for example, those listed in Table 8, homologs thereof, and orthologs thereof.

TABLE 8

RDR2 Proteins

| Organism | Gene Name | SED ID NO. |
|---|---|---|
| Arabidopsis thaliana | O82504 | 132 |
| Arabidopsis lyrata | XP_002872551 | 133 |
| Cucumis sativus | NP_001267608 | 134 |
| Vitis vinifera | XP_002280099 | 135 |
| Medicago truncatula | KEH31853 | 136 |
| Ricinus communis | XP_002511431 | 137 |
| Glycine max | XP_006579560 | 138 |
| Zea mays | NP_001183867 | 139 |
| Sorghum bicolor | XP_002446635 | 140 |
| Oryza sativa | EEE57765 | 141 |
| Brachypodium disiachyon | XP_003579930 | 142 |
| Populus trichocarpa | XP_002321582 | 143 |
| Brassica napus | CDX86814 | 144 |

In some embodiments, an RDR2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana RDR2 protein (SEQ ID NO: 132).

An RDR2-like protein may include the amino acid sequence or a fragment thereof of any RDR2 homolog or ortholog, such as any one of those listed in Table 8. One of skill would readily recognize that additional RDR2 homologs and/or orthologs may exist and may be used herein.

RDR2 is an RNA-dependent RNA polymerase and forms a complex with RNA Pol IV. RDR2 belongs to a clade of proteins that includes e.g. RDR1. Exemplary proteins in this clade, using A. thaliana as an exemplary host plant, include, for example, RDR1 (SEQ ID NO. 389). An alignment of various proteins in this clade from A. thaliana is provided in FIG. 4A-4B. The proteins in this clade, as well as homologs and orthologs thereof, may also be used in the methods and compositions of the present disclosure to target and silence a specific nucleic acid as described herein for RDR2-like proteins.

NRPD2A NRPE2 Proteins

Certain aspects of the present disclosure relate to NRPD2A/NRPE2-like proteins. In some embodiments, an NRPD2A/NRPE2-like protein refers to a recombinant NRPD2A/NRPE2 protein or fragment thereof and that contains a heterologous DNA-binding domain. In some embodiments, an NRPD2A/NRPE2-like protein refers to a recombinant NRPD2A/NRPE2 protein or fragment thereof that is fused to a CAS9 protein or fragment thereof. In some embodiments, an NRPD2A/NRPE2-like protein refers to a recombinant NRPD2A/NRPE2 protein or fragment thereof that is fused to an MS2 coat protein or fragment thereof. In some embodiments, an NRPD2A/NRPE2-like protein refers to a recombinant NRPD2A/NRPE2 protein or fragment thereof that is fused to an scFV antibody or fragment thereof. NRPD2A/NRPE2-like proteins may be used in reducing the expression of one or more target nucleic acids, such as genes, in plants.

NRPD2A/NRPE2 proteins are known in the art and are described herein. NRPD2A and NRPE2 are alternative names for the same protein, as is readily understood in the art. NRPD2A/NRPE2 proteins encode a subunit of RNA Pol IV. In some embodiments, an NRPD2A/NRPE2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPD2A/NRPE2 protein. In some embodiments, NRPD2A/NRPE2 protein fragments may include sequences with one or more amino acids removed from the consecutive amino acid sequence of a full-length NRPD2A/NRPE2 protein. In some embodiments, NRPD2A/NRPE2 protein fragments may include sequences with one or more amino acids replaced/substituted with an amino acid different from the endogenous amino acid present at a given amino acid position in a consecutive amino acid sequence of a full-length NRPD2A/NRPE2 protein. In some embodiments, NRPD2A/NRPE2 protein fragments may include sequences with one or more amino acids added to an otherwise consecutive amino acid sequence of a full-length NRPD2A/NRPE2 protein.

Suitable NRPD2A/NRPE2 proteins may be identified and isolated from monocot and dicot plants. Examples of such plants may include, for example, Arabidopsis spp., Ricinus communis, Glycine max, Zea Mays, Medicago truncatula, Physcomitrella patens, Sorghum bicolor, and Oryza sativa. Examples of suitable NRPD2A/NRPE2 proteins may include, for example, those listed in Table 9, homologs thereof, and orthologs thereof.

TABLE 9

NRPD2A/NRPE2 Proteins

| Organism | Gene Name | SED ID NO. |
|---|---|---|
| Arabidopsis thaliana | Q9LK40 | 145 |
| Arabidopsis lyrata | XP_002883108.1 | 146 |
| Cucumis sativus | XP_004145500.1 | 147 |
| Vitis vinifera | CBI21137.3 | 148 |
| Medicago truncatula | AES73546.2 | 149 |
| Ricinus communis | XP_002515428.1 | 150 |
| Glycine max | XP_003523670.1 | 151 |
| Zea mays | NP_001177299 | 152 |
| Sorghum bicolor | XP_002468227 | 153 |
| Oryza sativa | NP_001054041 | 154 |
| Brachypodium distachyon | XP_003577435.2 | 155 |
| Populus trichocarpa | XP_002324332.2 | 156 |
| Brassica napus | CDX92193 | 157 |

In some embodiments, an NRPD2A/NRPE2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana NRPD2A/NRPE2 protein (SEQ ID NO: 145).

An NRPD2A/NRPE2-like protein may include the amino acid sequence or a fragment thereof of any NRPD2A/NRPE2 homolog or ortholog, such as any one of those listed in Table 9. One of skill would readily recognize that additional NRPD2A/NRPE2 homologs and/or orthologs may exist and may be used herein.

NRPB3/NRPD3/NRPE3A Proteins

Certain aspects of the present disclosure relate to NRPB3/NRPD3/NRPE3A-like proteins. In some embodiments, an NRPB3/NRPD3/NRPE3A-like protein refers to a recombinant NRPB3/NRPD3/NRPE3A protein or fragment thereof and that contains a heterologous DNA-binding domain. In some embodiments, an NRPB3/NRPD3/NRPE3A-like protein refers to a recombinant NRPB3/NRPD3/NRPE3A protein or fragment thereof that is fused to a CAS9 protein or fragment thereof. In some embodiments, an NRPB3/NRPD3/NRPE3A-like protein refers to a recombinant NRPB3/NRPD3/NRPE3A protein or fragment thereof that is fused to an MS2 coat protein or fragment thereof. In some embodiments, an NRPB3/NRPD3/NRPE3A-like protein refers to a recombinant NRPB3/NRPD3/NRPE3A protein or fragment thereof that is fused to an scFV antibody or fragment thereof. NRPB3/NRPD3/NRPE3A-like proteins may be used in reducing the expression of one or more target nucleic acids, such as genes, in plants.

NRPB3/NRPD3/NRPE3A proteins are known in the art and are described herein. NRPB3, NRPD3, and NRPE3A are alternative names for the same protein, as is readily understood in the art. NRPB3/NRPD3/NRPE3A proteins encode a subunit of RNA Polymerases II, IV, and V. In some embodiments, an NRPB3/NRPD3/NRPE3A protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB3/NRPD3/NRPE3A protein. In some embodiments, NRPB3/NRPD3/NRPE3A protein fragments may include sequences with one or more amino acids removed from the consecutive amino acid sequence of a full-length NRPB3/NRPD3/NRPE3A protein. In some embodiments, NRPB3/NRPD3/NRPE3A protein fragments may include sequences with one or more amino acids replaced/substituted with an amino acid different from the endogenous amino acid present at a given amino acid position in a consecutive amino acid sequence of a full-length NRPB3/NRPD3/NRPE3A protein. In some embodiments, NRPB3/NRPD3/NRPE3A protein fragments may include sequences with one or more amino acids added to an otherwise consecutive amino acid sequence of a full-length NRPB3/NRPD3/NRPE3A protein.

Suitable NRPB3/NRPD3/NRPE3A proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable NRPB3/NRPD3/NRPE3A proteins may include, for example, those listed in Table 10, homologs thereof, and orthologs thereof.

TABLE 10

NRPB3/NRPD3/NRPE3A Proteins

| Organism | Gene Name | SEQ ID NO. |
| --- | --- | --- |
| *Arabidopsis thaliana* | Q39211 | 158 |
| *Arabidopsis lyrata* | XP_002883895 | 159 |
| *Cucumis sativus* | XP_004138895 | 160 |
| *Vitis vinifera* | CAN60923 | 161 |
| *Medicago truncatula* | XP_003607895 | 162 |
| *Ricinus communis* | XP_002518700 | 163 |
| *Glycine max* | XP_003529425 | 164 |
| *Zea mays* | NP_001149261 | 165 |
| *Sorghum bicolor* | XP_002462055 | 166 |
| *Oryza sativa* | NP_001062572 | 167 |
| *Brachypodium distachyon* | XP_003576823 | 168 |
| *Populus trichocarpa* | XP_002313865 | 169 |
| *Brassica napus* | CDY62312 | 170 |

In some embodiments, an NRPB3/NRPD3/NRPE3A protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB3/NRPD3/NRPE3A protein (SEQ ID NO. 158).

An NRPB3/NRPD3/NRPE3A-like protein may include the amino acid sequence or a fragment thereof of any NRPB3/NRPD3/NRPE3A homolog or ortholog, such as any one of those listed in Table 10. One of skill would readily recognize that additional NRPB3/NRPD3/NRPE3A homologs and/or orthologs may exist and may be used herein.

NRPE3B Proteins

Certain aspects of the present disclosure relate to NRPE3B-like proteins. In some embodiments, an NRPE3B-like protein refers to a recombinant NRPE3B protein or fragment thereof and that contains a heterologous DNA-binding domain. In some embodiments, an NRPE3B-like protein refers to a recombinant NRPE3B protein or fragment thereof that is fused to a CAS9 protein or fragment thereof. In some embodiments, an NRPE3B-like protein refers to a recombinant NRPE3B protein or fragment thereof that is fused to an MS2 coat protein or fragment thereof. In some embodiments, an NRPE3B-like protein refers to a recombinant NRPE3B protein or fragment thereof that is fused to an scFV antibody or fragment thereof. NRPE3B-like proteins may be used in reducing the expression of one or more target nucleic acids, such as genes, in plants.

NRPE3B proteins are known in the art and are described herein. NRPE3B proteins encode a subunit of RNA Pol V. In some embodiments, an NRPE3B protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPE3B protein. In some embodiments, NRPE3B protein fragments may include sequences with one or more amino acids removed from the consecutive amino acid sequence of a full-length NRPE3B protein. In some embodiments, NRPE3B protein fragments may include sequences with one or more amino acids replaced/substituted with an amino acid different from the endogenous amino acid present at a given amino acid position in a consecutive amino acid sequence of a full-length NRPE3B protein. In some embodiments, NRPE3B protein fragments may include sequences with one or more amino acids added to an otherwise consecutive amino acid sequence of a full-length NRPE3B protein.

Suitable NRPE3B proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPE3B proteins may include, for example, those listed in Table 11, homologs thereof, and orthologs thereof.

TABLE 11

NRPE3B Proteins

| Organism | Gene Name | SEQ ID NO. |
|---|---|---|
| *Arabidopsis thaliana* | Q39212 | 171 |
| *Arabidopsis lyrata* | XP_002883894 | 172 |
| *Cucumis sativus* | XP_004138895 | 173 |
| *Vitis vinifera* | CAN60923 | 174 |
| *Medicago truncatula* | XP_003607895 | 175 |
| *Ricinus communis* | XP_002518700 | 176 |
| *Glycine max* | XP_003529425 | 177 |
| *Zea mays* | NP_001149261 | 178 |
| *Sorghum bicolor* | XP_002462055 | 179 |
| *Oryza sativa* | XP_002960614 | 180 |
| *Brachypodium distachyon* | XP_003576823 | 181 |
| *Populus trichocarpa* | XP_002313865 | 182 |
| *Brassica napus* | CDY62312 | 183 |

In some embodiments, an NRPE3B protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPE3B protein (SEQ ID NO: 171).

An NRPE3B-like protein may include the amino acid sequence or a fragment thereof of any NRPE3B homolog or ortholog, such as any one of those listed in Table 11. One of skill would readily recognize that additional NRPE3B homologs and/or orthologs may exist and may be used herein.

NRPB11/NRPD11/NRPE11 Proteins

Certain aspects of the present disclosure relate to NRPB11/NRPD11/NRPE11-like proteins. In some embodiments, an NRPB11/NRPD11/NRPE11-like protein refers to a recombinant NRPB11/NRPD11/NRPE11 protein or fragment thereof and that contains a heterologous DNA-binding domain. In some embodiments, an NRPB11/NRPD11/NRPE11-like protein refers to a recombinant NRPB11/NRPD11/NRPE11 protein or fragment thereof that is fused to a CAS9 protein or fragment thereof. In some embodiments, an NRPB11/NRPD11/NRPE11-like protein refers to a recombinant NRPB11/NRPD11/NRPE11 protein or fragment thereof that is fused to an MS2 coat protein or fragment thereof. In some embodiments, an NRPB11/NRPD11/NRPE11-like protein refers to a recombinant NRPB11/NRPD11/NRPE11 protein or fragment thereof that is fused to an scFV antibody or fragment thereof. NRPB11/NRPD11/NRPE11-like proteins may be used in reducing the expression of one or more target nucleic acids, such as genes, in plants.

NRPB11/NRPD11/NRPE11 proteins are known in the art and are described herein. NRPB11, NRPD11, and NRPE11 are alternative names for the same protein, as is readily understood in the art. NRPB11/NRPD11/NRPE11 proteins encode a subunit of RNA Polymerases II, IV, and V. In some embodiments, an NRPB11/NRPD11/NRPE11 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB11/NRPD11/NRPE11 protein. In some embodiments, NRPB11/NRPD11/NRPE11 protein fragments may include sequences with one or more amino acids removed from the consecutive amino acid sequence of a full-length NRPB11/NRPD11/NRPE11 protein. In some embodiments, NRPB11/NRPD11/NRPE11 protein fragments may include sequences with one or more amino acids replaced/substituted with an amino acid different from the endogenous amino acid present at a given amino acid position in a consecutive amino acid sequence of a full-length NRPB11/NRPD11/NRPE11 protein. In some embodiments, NRPB11/NRPD11/NRPE11 protein fragments may include sequences with one or more amino acids added to an otherwise consecutive amino acid sequence of a full-length NRPB11/NRPD11/NRPE11 protein.

Suitable NRPB11/NRPD11/NRPE11 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPB11/NRPD11/NRPE11 proteins may include, for example, those listed in Table 12, homologs thereof, and orthologs thereof.

TABLE 12

NRPB11/NRPD11/NRPE11 Proteins

| Organism | Gene Name | SEQ ID NO. |
|---|---|---|
| *Arabidopsis thaliana* | F4J5R0 | 184 |
| *Arabidopsis lyrata* | XP_002877842 | 185 |
| *Cucumis sativus* | XP_004149719 | 186 |
| *Vitis vinifera* | CAN70445 | 187 |
| *Medicago truncatula* | KEH24769 | 188 |
| *Ricinus communis* | XP_002517812 | 189 |
| *Glycine max* | XP_003534400 | 190 |
| *Zea mays* | XP_008681546 | 191 |
| *Sorghum bicolor* | XP_002447457 | 192 |
| *Oryza sativa* | NP_001058998 | 193 |

TABLE 12-continued

NRPB11/NRPD11/NRPE11 Proteins

| Organism | Gene Name | SED ID NO. |
|---|---|---|
| Brachypodium distachyon | XP_003578343 | 194 |
| Populus trichocarpa | XP_002313254 | 195 |
| Brassica napus | CDY60635 | 196 |

In some embodiments, an NRPB11/NRPD11/NRPE11 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana NRPB11/NRPD11/NRPE11 protein (SEQ ID NO. 184).

An NRPB11/NRPD11/NRPE11-like protein may include the amino acid sequence or a fragment thereof of any NRPB11/NRPD11/NRPE11 homolog or ortholog, such as any one of those listed in Table 12. One of skill would readily recognize that additional NRPB11/NRPDT1/NRPE11 homologs and/or orthologs may exist and may be used herein.

NRPB10/NRPD10/NRPE10 Proteins

Certain aspects of the present disclosure relate to NRPB10/NRPD10/NRPE10-like proteins. In some embodiments, an NRPB10/NRPD10/NRPE10-like protein refers to a recombinant NRPB10/NRPD10/NRPE10 protein or fragment thereof and that contains a heterologous DNA-binding domain. In some embodiments, an NRPB10/NRPD10/NRPE10-like protein refers to a recombinant NRPB10/NRPD10/NRPE10 protein or fragment thereof that is fused to a CAS9 protein or fragment thereof. In some embodiments, an NRPB10/NRPD10/NRPE10-like protein refers to a recombinant NRPB10/NRPD10/NRPE10 protein or fragment thereof that is fused to an MS2 coat protein or fragment thereof. In some embodiments, an NRPB10/NRPD10/NRPE10-like protein refers to a recombinant NRPB10/NRPD10/NRPE10 protein or fragment thereof that is fused to an scFV antibody or fragment thereof. NRPB10/NRPD10/NRPE10-like proteins may be used in reducing the expression of one or more target nucleic acids, such as genes, in plants.

NRPB10/NRPD10/NRPE10 proteins are known in the art and are described herein. NRPB10, NRPD10, and NRPE10 are alternative names for the same protein, as is readily understood in the art. NRPB10/NRPD10/NRPE10 proteins encode a subunit of RNA Polymerases II, IV, and V. In some embodiments, an NRPB10/NRPD10/NRPE10 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB10/NRPD10/NRPE10 protein. In some embodiments, NRPB10/NRPD10/NRPE10 protein fragments may include sequences with one or more amino acids removed from the consecutive amino acid sequence of a full-length NRPB10/NRPD10/NRPE10 protein. In some embodiments, NRPB10/NRPD10/NRPE10 protein fragments may include sequences with one or more amino acids replaced/substituted with an amino acid different from the endogenous amino acid present at a given amino acid position in a consecutive amino acid sequence of a full-length NRPB10/NRPD10/NRPE10 protein. In some embodiments, NRPB10/NRPD10/NRPE10 protein fragments may include sequences with one or more amino acids added to an otherwise consecutive amino acid sequence of a full-length NRPB10/NRPD10/NRPE10 protein.

Suitable NRPB10/NRPD10/NRPE10 proteins may be identified and isolated from monocot and dicot plants. Examples of such plants may include, for example, Arabidopsis spp., Ricinus communis, Glycine max, Zea Mays, Medicago truncatula, Physcomitrella patens, Sorghum bicolor, and Oryza sativa. Examples of suitable NRPB10/NRPD10/NRPE10 proteins may include, for example, those listed in Table 13, homologs thereof, and orthologs thereof.

TABLE 13

NRPB10/NRPD10/NRPE10 Proteins

| Organism | Gene Name | SED ID NO. |
|---|---|---|
| Arabidopsis thaliana | Q8LFJ6 | 197 |
| Cucumis sativus | XP_004135479 | 198 |
| Vitis vinifera | XP_002263065 | 199 |
| Medicago truncatula | XP_003613211 | 200 |
| Ricinus communis | XP_002532739 | 201 |
| Glycine max | XP_003517695 | 202 |
| Zea mays | NP_001149707 | 203 |
| Sorghum bicolor | XP_002449154 | 204 |
| Oryza sativa | NP_001066312 | 205 |
| Brachypodium distachyon | XP_003578831 | 206 |
| Populus trichocarpa | XP_002303467 | 207 |
| Brassica napus | CDY25312 | 208 |

In some embodiments, an NRPB10/NRPD10/NRPE10 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana NRPB10/NRPD10/NRPE10 protein (SEQ ID NO. 197).

An NRPB10/NRPD10/NRPE10-like protein may include the amino acid sequence or a fragment thereof of any NRPB10/NRPD10/NRPE10 homolog or ortholog, such as any one of those listed in Table 13. One of skill would readily recognize that additional NRPB10/NRPD10/NRPE10 homologs and/or orthologs may exist and may be used herein. NRPB12/NRPD12/NRPE12 Proteins Certain aspects of the present disclosure relate to NRPB12/NRPD12/NRPE12-like proteins. In some embodiments, an NRPB12/NRPD12/NRPE12-like protein refers to a recombinant NRPB12/NRPD12/NRPE12 protein or fragment thereof and that contains a heterologous DNA-binding domain. In some embodiments, an NRPB12/NRPD12/NRPE12-like protein refers to a recombinant NRPB12/NRPD12/NRPE12 protein or fragment thereof that is fused to a CAS9 protein or fragment thereof. In some embodiments, an NRPB12/NRPD12/NRPE12-like protein refers to a recombinant NRPB12/NRPD12/NRPE12 protein or fragment thereof that is fused to an MS2 coat protein or fragment thereof. In some embodiments, an NRPB12/NRPD12/NRPE12-like protein refers to a recombinant NRPB12/NRPD12/NRPE12 protein or fragment thereof that is fused to an scFV antibody or fragment thereof. NRPB12/NRPD12/NRPE12-like proteins may be used in reducing the expression of one or more target nucleic acids, such as genes, in plants.

NRPB12/NRPD12/NRPE12 proteins are known in the art and are described herein. NRPB12, NRPD12, and NRPE12 are alternative names for the same protein, as is readily understood in the art. NRPB12/NRPD12/NRPE12 proteins encode a subunit of RNA Polymerases II, IV, and V. In some embodiments, an NRPB12/NRPD12/NRPE12 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB12/NRPD12/NRPE12 protein. In some embodiments, NRPB12/NRPD12/NRPE12 protein fragments may include sequences with one or more amino acids removed from the consecutive amino acid sequence of a full-length NRPB12/NRPD12/NRPE12 protein. In some embodiments, NRPB12/NRPD12/NRPE12 protein fragments may include sequences with one or more amino acids replaced/substituted with an amino acid different from the endogenous amino acid present at a given amino acid position in a consecutive amino acid sequence of a full-length NRPB12/NRPD12/NRPE12 protein. In some embodiments, NRPB12/NRPD12/NRPE12 protein fragments may include sequences with one or more amino acids added to an otherwise consecutive amino acid sequence of a full-length NRPB12/NRPD12/NRPE12 protein.

Suitable NRPB12/NRPD12/NRPE12 proteins may be identified and isolated from monocot and dicot plants. Examples of such plants may include, for example, *Arabidopsis* spp., *Ricinus communis, Glycine max, Zea Mays, Medicago truncatula, Physcomitrella patens,* and *Oryza sativa*. Examples of suitable NRPB12/NRPD12/NRPE12 proteins may include, for example, those listed in Table 14, homologs thereof, and orthologs thereof.

TABLE 14

NRPB12/NRPD12/NRPE12 Proteins

| Organism | Gene Name | SED ID NO. |
| --- | --- | --- |
| *Arabidopsis thaliana* | Q9FLM8 | 209 |
| *Arabidopsis lyrata* | XP_002870659 | 210 |
| *Cucumis sativus* | KGN64215 | 211 |
| *Vitis vinifera* | XP_010662206 | 212 |
| *Medicago truncatula* | AFK41236 | 213 |

TABLE 14-continued

NRPB12/NRPD12/NRPE12 Proteins

| Organism | Gene Name | SED ID NO. |
| --- | --- | --- |
| *Ricinus communis* | XP_002527516 | 214 |
| *Glycine max* | XP_003534102 | 215 |
| *Zea mays* | ACG30756 | 216 |
| *Oryza sativa* | NP_001172391 | 217 |
| *Brachypodium distachyon* | XP_003563174 | 218 |
| *Populus trichocarpa* | XP_002317630 | 219 |
| *Brassica napus* | CDY24079 | 220 |

In some embodiments, an NRPB12/NRPD12/NRPE12 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB12/NRPD12/NRPE12 protein (SEQ ID NO. 209).

An NRPB12/NRPD12/NRPE12-like protein may include the amino acid sequence or a fragment thereof of any NRPB12/NRPD12/NRPE12 homolog or ortholog, such as any one of those listed in Table 14. One of skill would readily recognize that additional NRPB12/NRPD12/NRPE12 homologs and/or orthologs may exist and may be used herein. NRPB6A/NRPD6A/NRPE6A Proteins Certain aspects of the present disclosure relate to NRPB6A/NRPD6A/NRPE6A-like proteins. In some embodiments, an NRPB6A/NRPD6A/NRPE6A-like protein refers to a recombinant NRPB6A/NRPD6A/NRPE6A protein or fragment thereof and that contains a heterologous DNA-binding domain. In some embodiments, an NRPB6A/NRPD6A/NRPE6A-like protein refers to a recombinant NRPB6A/NRPD6A/NRPE6A protein or fragment thereof that is fused to a CAS9 protein or fragment thereof. In some embodiments, an NRPB6A/NRPD6A/NRPE6A-like protein refers to a recombinant NRPB6A/NRPD6A/NRPE6A protein or fragment thereof that is fused to an MS2 coat protein or fragment thereof. In some embodiments, an NRPB6A/NRPD6A/NRPE6A-like protein refers to a recombinant NRPB6A/NRPD6A/NRPE6A protein or fragment thereof that is fused to an scFV antibody or fragment thereof. NRPB6A/NRPD6A/NRPE6A-like proteins may be used in reducing the expression of one or more target nucleic acids, such as genes, in plants.

NRPB6A/NRPD6A/NRPE6A proteins are known in the art and are described herein. NRPB6A, NRPD6A, and NRPE6A are alternative names for the same protein, as is readily understood in the art. NRPB6A/NRPD6A/NRPE6A proteins encode a subunit of RNA Polymerases II, IV, and V. In some embodiments, an NRPB6A/NRPD6A/NRPE6A protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB6A/NRPD6A/NRPE6A protein. In some embodiments, NRPB6A/NRPD6A/NRPE6A protein fragments may include sequences with one or more amino acids removed from the consecutive amino acid sequence of a full-length NRPB6A/NRPD6A/NRPE6A protein. In some embodiments, NRPB6A/NRPD6A/NRPE6A protein fragments may include sequences with one or more amino acids replaced/substituted with an amino acid different from the endogenous amino acid present at a given amino acid position in a consecutive amino acid sequence of a full-length NRPB6A/NRPD6A/NRPE6A protein. In some embodiments, NRPB6A/NRPD6A/NRPE6A protein fragments may include sequences with one or more amino acids added to an otherwise consecutive amino acid sequence of a full-length NRPB6A/NRPD6A/NRPE6A protein.

Suitable NRPB6A/NRPD6A/NRPE6A proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPB6A/NRPD6A/NRPE6A proteins may include, for example, those listed in Table 15, homologs thereof, and orthologs thereof.

TABLE 15

NRPB6A/NRPD6A/NRPE6A Proteins

| Organism | Gene Name | SEQ ID NO. |
|---|---|---|
| Arabidopsis thaliana | Q9SJ96 | 221 |
| Arabidopsis lyrata | XP_002885765 | 222 |
| Cucumis sativus | XP_004136357 | 223 |
| Vitis vinifera | XP_002282723 | 224 |
| Medicago truncatula | XP_003625191 | 225 |
| Ricinus communis | XP_002510834 | 226 |
| Glycine max | XP_003536478 | 227 |
| Zea mays | ACF83139 | 228 |
| Sorghum bicolor | XP_002459814 | 229 |
| Oryza sativa | NP_001050570 | 230 |
| Brachypodium distachyon | XP_003575153 | 231 |
| Populus trichocarpa | XP_002322450 | 232 |
| Brassica napus | CDY30291 | 233 |

In some embodiments, an NRPB6A/NRPD6A/NRPE6A protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB6A/NRPD6A/NRPE6A protein (SEQ ID NO: 221).

An NRPB6A/NRPD6A/NRPE6A-like protein may include the amino acid sequence or a fragment thereof of any NRPB6A/NRPD6A/NRPE6A homolog or ortholog, such as any one of those listed in Table 15. One of skill would readily recognize that additional NRPB6A/NRPD6A/NRPE6A homologs and/or orthologs may exist and may be used herein. NRPB6B/NRPD6B/NRPE6B Proteins Certain aspects of the present disclosure relate to NRPB6B/NRPD6B/NRPE6B-like proteins. In some embodiments, an NRPB6B/NRPD6B/NRPE6B-like protein refers to a recombinant NRPB6B/NRPD6B/NRPE6B protein or fragment thereof and that contains a heterologous DNA-binding domain. In some embodiments, an NRPB6B/NRPD6B/NRPE6B-like protein refers to a recombinant NRPB6B/NRPD6B/NRPE6B protein or fragment thereof that is fused to a CAS9 protein or fragment thereof. In some embodiments, an NRPB6B/NRPD6B/NRPE6B-like protein refers to a recombinant NRPB6B/NRPD6B/NRPE6B protein or fragment thereof that is fused to an MS2 coat protein or fragment thereof. In some embodiments, an NRPB6B/NRPD6B/NRPE6B-like protein refers to a recombinant NRPB6B/NRPD6B/NRPE6B protein or fragment thereof that is fused to an scFV antibody or fragment thereof. NRPB6B/NRPD6B/NRPE6B-like proteins may be used in reducing the expression of one or more target nucleic acids, such as genes, in plants.

NRPB6B/NRPD6B/NRPE6B proteins are known in the art and are described herein. NRPB6B, NRPD6B, and NRPE6B are alternative names for the same protein, as is readily understood in the art. NRPB6B/NRPD6B/NRPE6B proteins encode a subunit of RNA Polymerases II and V. In some embodiments, an NRPB6B/NRPD6B/NRPE6B protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB6B/NRPD6B/NRPE6B protein. In some embodiments, NRPB6B/NRPD6B/NRPE6B protein fragments may include sequences with one or more amino acids removed from the consecutive amino acid sequence of a full-length NRPB6B/NRPD6B/NRPE6B protein. In some embodiments, NRPB6B/NRPD6B/NRPE6B protein fragments may include sequences with one or more amino acids replaced/substituted with an amino acid different from the endogenous amino acid present at a given amino acid position in a consecutive amino acid sequence of a full-length NRPB6B/NRPD6B/NRPE6B protein. In some embodiments, NRPB6B/NRPD6B/NRPE6B protein fragments may include sequences with one or more amino acids added to an otherwise consecutive amino acid sequence of a full-length NRPB6B/NRPD6B/NRPE6B protein.

Suitable NRPB6B/NRPD6B/NRPE6B proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPB6B/NRPD6B/NRPE6B proteins may include, for example, those listed in Table 16, homologs thereof, and orthologs thereof.

TABLE 16

NRPB6B/NRPD6B/NRPE6B Proteins

| Organism | Gene Name | SEQ ID NO. |
|---|---|---|
| *Arabidopsis thaliana* | Q9SJ96 | 234 |
| *Arabidopsis lyrata* | XP_002885765 | 235 |
| *Cucumis sativus* | XP_004140788 | 236 |
| *Vitis vinifera* | CAN62586 | 237 |
| *Medicago truncatula* | KEH17383 | 238 |
| *Ricinus communis* | XP_002510834 | 239 |
| *Glycine max* | XP_003536478 | 240 |
| *Zea mays* | ACG24540 | 241 |
| *Sorghum bicolor* | XP_002459814 | 242 |
| *Oryza sativa* | NP_001050570 | 243 |
| *Brachypodium distachyon* | XP_003575153 | 244 |
| *Populus trichocarpa* | XP_002322450 | 245 |
| *Brassica napus* | CDY30291 | 246 |

In some embodiments, an NRPB6B/NRPD6B/NRPE6B protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB6B/NRPD6B/NRPE6B protein (SEQ ID NO: 234).

An NRPB6B/NRPD6B/NRPE6B-like protein may include the amino acid sequence or a fragment thereof of any NRPB6B/NRPD6B/NRPE6B homolog or ortholog, such as any one of those listed in Table 16. One of skill would readily recognize that additional NRPB6B/NRPD6B/NRPE6B homologs and/or orthologs may exist and may be used herein.

NRPB8A/NRPE8A Proteins

Certain aspects of the present disclosure relate to NRPB8A/NRPE8A-like proteins. In some embodiments, an NRPB8A/NRPE8A-like protein refers to a recombinant NRPB8A/NRPE8A protein or fragment thereof and that contains a heterologous DNA-binding domain. In some embodiments, an NRPB8A/NRPE8A-like protein refers to a recombinant NRPB8A/NRPE8A protein or fragment thereof that is fused to a CAS9 protein or fragment thereof. In some embodiments, an NRPB8A/NRPE8A-like protein refers to a recombinant NRPB8A/NRPE8A protein or fragment thereof that is fused to an MS2 coat protein or fragment thereof. In some embodiments, an NRPB8A/NRPE8A-like protein refers to a recombinant NRPB8A/NRPE8A protein or fragment thereof that is fused to an scFV antibody or fragment thereof. NRPB8A/NRPE8A-like proteins may be used in reducing the expression of one or more target nucleic acids, such as genes, in plants.

NRPB8A/NRPE8A proteins are known in the art and are described herein. NRPB8A and NRPE8A are alternative names for the same protein, as is readily understood in the art. NRPB8A/NRPE8A proteins encode a subunit of RNA Polymerases II and V. In some embodiments, an NRPB8A/NRPE8A protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB8A/NRPE8A protein. In some embodiments, NRPB8A/NRPE8A protein fragments may include sequences with one or more amino acids removed from the consecutive amino acid sequence of a full-length NRPB8A/NRPE8A protein. In some embodiments, NRPB8A/NRPE8A protein fragments may include sequences with one or more amino acids replaced/substituted with an amino acid different from the endogenous amino acid present at a given amino acid position in a consecutive amino acid sequence of a full-length NRPB8A/NRPE8A protein. In some embodiments, NRPB8A/NRPE8A protein fragments may include sequences with one or more amino acids added to an otherwise consecutive amino acid sequence of a full-length NRPB8A/NRPE8A protein.

Suitable NRPB8A/NRPE8A proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPB8A/NRPE8A proteins may include, for example, those listed in Table 17, homologs thereof, and orthologs thereof.

TABLE 17

NRPB8A/NRPE8A Proteins

| Organism | Gene Name | SEQ ID NO. |
|---|---|---|
| *Arabidopsis thaliana* | O81097 | 247 |
| *Arabidopsis lyrata* | XP_002891800 | 248 |
| *Cucumis sativus* | XP_004149143 | 249 |
| *Vitis vinifera* | CAN73856 | 250 |
| *Medicago truncatula* | AFK42881 | 251 |
| *Ricinus communis* | XP_002530308 | 252 |
| *Glycine max* | NP_001237035 | 253 |
| *Zea mays* | NP_001147399 | 254 |
| *Sorghum bicolor* | XP_002466106 | 255 |
| *Oryza sativa* | NP_001051880 | 256 |
| *Brachypodium distachyon* | XP_010227253 | 257 |
| *Populus trichocarpa* | XP_006376377 | 258 |
| *Brassica rapa* | XP_009116628 | 259 |

In some embodiments, an NRPB8A/NRPE8A protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB8A/NRPE8A protein (SEQ ID NO: 247).

An NRPB8A/NRPE8A-like protein may include the amino acid sequence or a fragment thereof of any NRPB8A/NRPE8A homolog or ortholog, such as any one of those listed in Table 17. One of skill would readily recognize that additional NRPB8A/NRPE8A homologs and/or orthologs may exist and may be used herein.

NRPB8B NRPD8B NRPE8B Proteins

Certain aspects of the present disclosure relate to NRPB8B/NRPD8B/NRPE8B-like proteins. In some embodiments, an NRPB8B/NRPD8B/NRPE8B-like protein refers to a recombinant NRPB8B/NRPD8B/NRPE8B protein or fragment thereof and that contains a heterologous DNA-binding domain. In some embodiments, an NRPB8B/NRPD8B/NRPE8B-like protein refers to a recombinant NRPB8B/NRPD8B/NRPE8B protein or fragment thereof that is fused to a CAS9 protein or fragment thereof. In some embodiments, an NRPB8B/NRPD8B/NRPE8B-like protein refers to a recombinant NRPB8B/NRPD8B/NRPE8B protein or fragment thereof that is fused to an MS2 coat protein or fragment thereof. In some embodiments, an NRPB8B/NRPD8B/NRPE8B-like protein refers to a recombinant NRPB8B/NRPD8B/NRPE8B protein or fragment thereof that is fused to an scFV antibody or fragment thereof. NRPB8B/NRPD8B/NRPE8B-like proteins may be used in reducing the expression of one or more target nucleic acids, such as genes, in plants.

NRPB8B/NRPD8B/NRPE8B proteins are known in the art and are described herein. NRPB8B, NRPD8B, and NRPE8B are alternative names for the same protein, as is readily understood in the art. NRPB8B/NRPD8B/NRPE8B proteins encode a subunit of RNA Polymerases II, IV, and V. In some embodiments, an NRPB8B/NRPD8B/NRPE8B protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB8B/NRPD8B/NRPE8B protein. In some embodiments, NRPB8B/NRPD8B/NRPE8B protein fragments may include sequences with one or more amino acids removed from the consecutive amino acid sequence of a full-length NRPB8B/NRPD8B/NRPE8B protein. In some embodiments, NRPB8B/NRPD8B/NRPE8B protein fragments may include sequences with one or more amino acids replaced/substituted with an amino acid different from the endogenous amino acid present at a given amino acid position in a consecutive amino acid sequence of a full-length NRPB8B/NRPD8B/NRPE8B protein. In some embodiments, NRPB8B/NRPD8B/NRPE8B protein fragments may include sequences with one or more amino acids added to an otherwise consecutive amino acid sequence of a full-length NRPB8B/NRPD8B/NRPE8B protein.

Suitable NRPB8B/NRPD8B/NRPE8B proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPB8B/NRPD8B/NRPE8B proteins may include, for example, those listed in Table 18, homologs thereof, and orthologs thereof.

TABLE 18

NRPB8B/NRPD8B/NRPE8B Proteins

| Organism | Gene Name | SED ID NO. |
|---|---|---|
| *Arabidopsis thaliana* | O81097 | 260 |
| *Arabidopsis lyrata* | XP_002891800 | 261 |

TABLE 18-continued

NRPB8B/NRPD8B/NRPE8B Proteins

| Organism | Gene Name | SED ID NO. |
|---|---|---|
| *Cucumis sativus* | XP_004149143 | 262 |
| *Vitis vinifera* | CAN73856 | 263 |
| *Medicago truncatula* | AFK42881 | 264 |
| *Ricinus communis* | XP_002530308 | 265 |
| *Glycine max* | NP_001237035 | 266 |
| *Zea mays* | NP_001147399 | 267 |
| *Sorghum bicolor* | XP_002466106 | 268 |
| *Oryza sativa* | NP_001051880 | 269 |
| *Brachypodium distachyon* | XP_010227253 | 270 |
| *Populus trichocarpa* | XP_006376377 | 271 |
| *Brassica rapa* | XP_009116628 | 272 |

In some embodiments, an NRPB8B/NRPD8B/NRPE8B protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB8B/NRPD8B/NRPE8B protein (SEQ ID NO: 260).

An NRPB8B/NRPD8B/NRPE8B-like protein may include the amino acid sequence or a fragment thereof of any NRPB8B/NRPD8B/NRPE8B homolog or ortholog, such as any one of those listed in Table 18. One of skill would readily recognize that additional NRPB8B/NRPD8B/NRPE8B homologs and/or orthologs may exist and may be used herein.

NRPE5 Proteins

Certain aspects of the present disclosure relate to NRPE5-like proteins. In some embodiments, an NRPE5-like protein refers to a recombinant NRPE5 protein or fragment thereof and that contains a heterologous DNA-binding domain. In some embodiments, an NRPE5-like protein refers to a recombinant NRPE5 protein or fragment thereof that is fused to a CAS9 protein or fragment thereof. In some embodiments, an NRPE5-like protein refers to a recombinant NRPE5 protein or fragment thereof that is fused to an MS2 coat protein or fragment thereof. In some embodiments, an NRPE5-like protein refers to a recombinant NRPE5 protein or fragment thereof that is fused to an scFV antibody or fragment thereof. NRPE5-like proteins may be used in reducing the expression of one or more target nucleic acids, such as genes, in plants.

NRPE5 proteins are known in the art and are described herein. NRPE5 proteins encode a subunit of RNA Pol V. In some embodiments, an NRPE5 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPE5 protein. In some embodiments, NRPE5 protein fragments may include sequences with one or more amino acids removed from the consecutive amino acid sequence of a full-length NRPE5 protein. In some embodiments, NRPE5 protein fragments may include sequences with one or more amino acids replaced/substituted with an amino acid different from the endogenous amino acid present at a given amino acid position in a consecutive amino acid sequence of a full-length NRPE5 protein. In some embodiments, NRPE5 protein fragments may include sequences with one or more amino acids added to an otherwise consecutive amino acid sequence of a full-length NRPE5 protein.

Suitable NRPE5 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPE5 proteins may include, for example, those listed in Table 19, homologs thereof, and orthologs thereof.

TABLE 19

NRPE5 Proteins

| Organism | Gene Name | SEQ ID NO. |
|---|---|---|
| *Arabidopsis thaliana* | Q9M1J2 | 273 |
| *Arabidopsis lyrata* | XP_002876396.1 | 274 |
| *Cucumis sativus* | XP_004136650.1 | 275 |
| *Vitis vinifera* | XP_003632734 | 276 |
| *Medicago truncatula* | XP_003625033.1 | 277 |
| *Ricinus communis* | XP_002513077.1 | 278 |
| *Glycine max* | NP_001236527.1 | 279 |
| *Zea mays* | ACG37268 | 280 |
| *Sorghum bicolor* | XP_002450250.1 | 281 |
| *Oryza sativa* | NP_001066119.1 | 282 |
| *Brachypodium distachyon* | XP_010237978.1 | 283 |
| *Populus trichocarpa* | XP_002323257.2 | 284 |
| *Brassica napus* | CDX72073 | 285 |

In some embodiments, an NRPE5 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPE5 protein (SEQ ID NO: 273).

An NRPE5-like protein may include the amino acid sequence or a fragment thereof of any NRPE5 homolog or ortholog, such as any one of those listed in Table 19. One of skill would readily recognize that additional NRPE5 homologs and/or orthologs may exist and may be used herein.

NRPD4 NRPE4 Proteins

Certain aspects of the present disclosure relate to NRPD4/NRPE4-like proteins. In some embodiments, an NRPD4/NRPE4-like protein refers to a recombinant NRPD4/NRPE4 protein or fragment thereof and that contains a heterologous DNA-binding domain. In some embodiments, an NRPD4/NRPE4-like protein refers to a recombinant NRPD4/NRPE4 protein or fragment thereof that is fused to a CAS9 protein or fragment thereof. In some embodiments, an NRPD4/NRPE4-like protein refers to a recombinant NRPD4/NRPE4 protein or fragment thereof that is fused to an MS2 coat protein or fragment thereof. In some embodiments, an NRPD4/NRPE4-like protein refers to a recombinant NRPD4/NRPE4 protein or fragment thereof that is fused to an scFV antibody or fragment thereof. NRPD4/NRPE4-like proteins may be used in reducing the expression of one or more target nucleic acids, such as genes, in plants.

NRPD4/NRPE4 proteins are known in the art and are described herein. NRPD4 and NRPE4 are alternative names for the same protein, as is readily understood in the art. NRPD4/NRPE4 proteins encode a subunit of RNA Polymerases IV and V. In some embodiments, an NRPD4/NRPE4 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPD4/NRPE4 protein. In some embodiments, NRPD4/NRPE4 protein fragments may include sequences with one or more amino acids removed from the consecutive amino acid sequence of a full-length NRPD4/NRPE4 protein. In some embodiments, NRPD4/NRPE4 protein fragments may include sequences with one or more amino acids replaced/substituted with an amino acid different from the endogenous amino acid present at a given amino acid position in a consecutive amino acid sequence of a full-length NRPD4/NRPE4 protein. In some embodiments, NRPD4/NRPE4 protein fragments may include sequences with one or more amino acids added to an otherwise consecutive amino acid sequence of a full-length NRPD4/NRPE4 protein.

Suitable NRPD4/NRPE4 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor*, and *Oryza sativa*. Examples of suitable NRPD4/NRPE4 proteins may include, for example, those listed in Table 20, homologs thereof, and orthologs thereof.

TABLE 20

NRPD4/NRPE4 Proteins

| Organism | Gene Name | SEQ ID NO. |
|---|---|---|
| *Arabidopsis thaliana* | F4JKY1 | 286 |
| *Arabidopsis lyrata* | XP_002870197.1 | 287 |
| *Cucumis sativus* | KGN49020.1 | 288 |
| *Vitis vinifera* | XP_010646234 | 289 |
| *Medicago truncatula* | AFK45778.1 | 290 |
| *Ricinus communis* | XP_002525033.1 | 291 |
| *Glycine max* | XP_003534990.1 | 292 |
| *Zea mays* | NP_001130236.1 | 293 |
| *Sorghum bicolor* | XP_002453184 | 294 |
| *Oryza sativa* | BAH01271.1 | 295 |
| *Brachypodiurn distachyon* | XP_010236010.1 | 296 |
| *Populus trichocarpa* | XP_006373571.1 | 297 |
| *Brassica napus* | CDY37333 | 298 |

In some embodiments, an NRPD4/NRPE4 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPD4/NRPE4 protein (SEQ ID NO: 286).

An NRPD4/NRPE4-like protein may include the amino acid sequence or a fragment thereof of any NRPD4/NRPE4 homolog or ortholog, such as any one of those listed in Table 20. One of skill would readily recognize that additional NRPD4/NRPE4 homologs and/or orthologs may exist and may be used herein.

NRPE7 Proteins

Certain aspects of the present disclosure relate to NRPE7-like proteins. In some embodiments, an NRPE7-like protein refers to a recombinant NRPE7 protein or fragment thereof and that contains a heterologous DNA-binding domain. In some embodiments, an NRPE7-like protein refers to a recombinant NRPE7 protein or fragment thereof that is fused to a CAS9 protein or fragment thereof. In some embodiments, an NRPE7-like protein refers to a recombinant NRPE7 protein or fragment thereof that is fused to an MS2 coat protein or fragment thereof. In some embodiments, an NRPE7-like protein refers to a recombinant NRPE7 protein or fragment thereof that is fused to an scFV antibody or fragment thereof. NRPE7-like proteins may be used in reducing the expression of one or more target nucleic acids, such as genes, in plants.

NRPE7 proteins are known in the art and are described herein. NRPE7 proteins encode a subunit of RNA Pol V. In some embodiments, an NRPE7 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPE7 protein. In some embodiments, NRPE7 protein fragments may include sequences with one or more amino acids removed from the consecutive amino acid sequence of a full-length NRPE7 protein. In some embodiments, NRPE7 protein fragments may include sequences with one or more amino acids replaced/substituted with an amino acid different from the endogenous amino acid present at a given amino acid position in a consecutive amino acid sequence of a full-length NRPE7 protein. In some embodiments, NRPE7 protein fragments may include sequences with one or more amino acids added to an otherwise consecutive amino acid sequence of a full-length NRPE7 protein.

Suitable NRPE7 proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable NRPE7 proteins may include, for example, those listed in Table 21, homologs thereof, and orthologs thereof.

TABLE 21

NRPE7 Proteins

| Organism | Gene Name | SEQ ID NO. |
|---|---|---|
| Arabidopsis thaliana | A6QRA1 | 299 |
| Arabidopsis lyrata | XP_002868270.1 | 300 |
| Cucumis sativus | XP_004150402.1 | 301 |
| Vitis vinifera | XP_002284221.1 | 302 |
| Medicago truncatula | AFK37080.1 | 303 |
| Ricinus communis | XP_002522607.1 | 304 |
| Glycine max | XP_006605321.1 | 305 |
| Zea mays | NP_001150375 | 306 |
| Sorghum bicolor | XP_002439325.1 | 307 |
| Oryza sativa | NP_001054703.1 | 308 |
| Brachypodium distachyon | XP_003568883.1 | 309 |
| Populus trichocarpa | XP_002312568.1 | 310 |
| Brassica napus | CDY40821 | 311 |

In some embodiments, an NRPE7 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPE7 protein (SEQ ID NO: 299).

An NRPE7-like protein may include the amino acid sequence or a fragment thereof of any NRPE7 homolog or ortholog, such as any one of those listed in Table 21. One of skill would readily recognize that additional NRPE7 homologs and/or orthologs may exist and may be used herein.

NRPD7 Proteins

Certain aspects of the present disclosure relate to NRPD7-like proteins. In some embodiments, an NRPD7-like protein refers to a recombinant NRPD7 protein or fragment thereof and that contains a heterologous DNA-binding domain. In some embodiments, an NRPD7-like protein refers to a recombinant NRPD7 protein or fragment thereof that is fused to a CAS9 protein or fragment thereof. In some embodiments, an NRPD7-like protein refers to a recombinant NRPD7 protein or fragment thereof that is fused to an MS2 coat protein or fragment thereof. In some embodiments, an NRPD7-like protein refers to a recombinant NRPD7 protein or fragment thereof that is fused to an scFV antibody or fragment thereof. NRPD7-like proteins may be used in reducing the expression of one or more target nucleic acids, such as genes, in plants.

NRPD7 proteins are known in the art and are described herein. NRPD7 proteins encode a subunit of RNA Pol IV. In some embodiments, an NRPD7 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPD7 protein. In some embodiments, NRPD7 protein fragments may include sequences with one or more amino acids removed from the consecutive amino acid sequence of a full-length NRPD7 protein. In some embodiments, NRPD7 protein fragments may include sequences with one or more amino acids replaced/substituted with an amino acid different from the endogenous amino acid present at a given amino acid position in a consecutive amino acid sequence of a full-length NRPD7 protein. In some embodiments, NRPD7 protein fragments may include sequences with one or more amino acids added to an otherwise consecutive amino acid sequence of a full-length NRPD7 protein.

Suitable NRPD7 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor,* and *Oryza sativa*. Examples of suitable NRPD7 proteins may include, for example, those listed in Table 22, homologs thereof, and orthologs thereof.

TABLE 22

NRPD7 Proteins

| Organism | Gene Name | SEQ ID NO. |
|---|---|---|
| *Arabidopsis thaliana* | Q8LE42 | 312 |
| *Arabidopsis lyrata* | XP_002883384.1 | 313 |
| *Cucumis sativus* | XP_004150402.1 | 314 |
| *Vitis vinifera* | XP_002284221.1 | 315 |
| *Medicago truncatula* | AFK37080.1 | 316 |
| *Ricinus communis* | XP_002522607.1 | 317 |
| *Glycine max* | XP_006605319.1 | 318 |
| *Zea mays* | NP_001150375 | 319 |
| *Sorghum bicolor* | XP_002439325 | 320 |
| *Oryza sativa* | EEC78737.1 | 321 |
| *Brachypodium distachyon* | XP_003568883 | 322 |
| *Populus trichocarpa* | XP_002312568 | 323 |
| *Brassica napus* | CDY40821 | 324 |

In some embodiments, an NRPD7 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPD7 protein (SEQ ID NO: 312).

An NRPD7-like protein may include the amino acid sequence or a fragment thereof of any NRPD7 homolog or ortholog, such as any one of those listed in Table 22. One of skill would readily recognize that additional NRPD7 homologs and/or orthologs may exist and may be used herein.

NRPB5 NRPD5 Proteins

Certain aspects of the present disclosure relate to NRPB5/NRPD5-like proteins. In some embodiments, an NRPB5/NRPD5-like protein refers to a recombinant NRPB5/NRPD5 protein or fragment thereof and that contains a heterologous DNA-binding domain. In some embodiments, an NRPB5/NRPD5-like protein refers to a recombinant NRPB5/NRPD5 protein or fragment thereof that is fused to a CAS9 protein or fragment thereof. In some embodiments, an NRPB5/NRPD5-like protein refers to a recombinant NRPB5/NRPD5 protein or fragment thereof that is fused to an MS2 coat protein or fragment thereof. In some embodiments, an NRPB5/NRPD5-like protein refers to a recombinant NRPB5/NRPD5 protein or fragment thereof that is fused to an scFV antibody or fragment thereof. NRPB5/NRPD5-like proteins may be used in reducing the expression of one or more target nucleic acids, such as genes, in plants.

NRPB5/NRPD5 proteins are known in the art and are described herein. NRPB5 and NRPD5 are alternative names for the same protein, as is readily understood in the art. NRPB5/NRPD5 proteins encode a subunit of RNA Polymerases I, II, III, and IV. In some embodiments, an NRPB5/NRPD5 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB5/NRPD5 protein. In some embodiments, NRPB5/NRPD5 protein fragments may include sequences with one or more amino acids removed from the consecutive amino acid sequence of a full-length NRPB5/NRPD5 protein. In some embodiments, NRPB5/NRPD5 protein fragments may include sequences with one or more amino acids replaced/substituted with an amino acid different from the endogenous amino acid present at a given amino acid position in a consecutive amino acid sequence of a full-length NRPB5/NRPD5 protein. In some embodiments, NRPB5/NRPD5 protein fragments may include sequences with one or more amino acids added to an otherwise consecutive amino acid sequence of a full-length NRPB5/NRPD5 protein.

Suitable NRPB5/NRPD5 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor,* and *Oryza sativa*. Examples of suitable NRPB5/NRPD5 proteins may include, for example, those listed in Table 23, homologs thereof, and orthologs thereof.

TABLE 23

NRPB5/NRPD5 Proteins

| Organism | Gene Name | SEQ ID NO. |
|---|---|---|
| *Arabidopsis thaliana* | O81098 | 325 |
| *Arabidopsis lyrata* | XP_002885498 | 326 |
| *Cucumis sativus* | XP_004148944 | 327 |
| *Vitis vinifera* | XP_002284107 | 328 |
| *Medicago truncatula* | AFK41303 | 329 |
| *Ricinus communis* | XP_002514265 | 330 |
| *Glycine max* | NP_001238044 | 331 |
| *Zea mays* | NP_001132429 | 332 |
| *Oryza sativa* | NP_001044564 | 333 |
| *Brachypodium distachyon* | XP_003564430 | 334 |

TABLE 23-continued

NRPB5/NRPD5 Proteins

| Organism | Gene Name | SEQ ID NO. |
|---|---|---|
| Populus trichocarpa | XP_002323257 | 335 |
| Brassica napus | CDY37407 | 336 |

In some embodiments, an NRPB5/NRPD5 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB5/NRPD5 protein (SEQ ID NO: 325).

An NRPB5/NRPD5-like protein may include the amino acid sequence or a fragment thereof of any NRPB5/NRPD5 homolog or ortholog, such as any one of those listed in Table 23. One of skill would readily recognize that additional NRPB5/NRPD5 homologs and/or orthologs may exist and may be used herein.

NRPB9A/NRPD9A/NRPE9A Proteins

Certain aspects of the present disclosure relate to NRPB9A/NRPD9A/NRPE9A-like proteins. In some embodiments, an NRPB9A/NRPD9A/NRPE9A-like protein refers to a recombinant NRPB9A/NRPD9A/NRPE9A protein or fragment thereof and that contains a heterologous DNA-binding domain. In some embodiments, an NRPB9A/NRPD9A/NRPE9A-like protein refers to a recombinant NRPB9A/NRPD9A/NRPE9A protein or fragment thereof that is fused to a CAS9 protein or fragment thereof. In some embodiments, an NRPB9A/NRPD9A/NRPE9A-like protein refers to a recombinant NRPB9A/NRPD9A/NRPE9A protein or fragment thereof that is fused to an MS2 coat protein or fragment thereof. In some embodiments, an NRPB9A/NRPD9A/NRPE9A-like protein refers to a recombinant NRPB9A/NRPD9A/NRPE9A protein or fragment thereof that is fused to an scFV antibody or fragment thereof. NRPB9A/NRPD9A/NRPE9A-like proteins may be used in reducing the expression of one or more target nucleic acids, such as genes, in plants.

NRPB9A/NRPD9A/NRPE9A proteins are known in the art and are described herein. NRPB9A, NRPD9A, and NRPE9A are alternative names for the same protein, as is readily understood in the art. NRPB9A/NRPD9A/NRPE9A proteins encode a subunit of RNA Polymerases II, IV, and V. In some embodiments, an NRPB9A/NRPD9A/NRPE9A protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB9A/NRPD9A/NRPE9A protein. In some embodiments, NRPB9A/NRPD9A/NRPE9A protein fragments may include sequences with one or more amino acids removed from the consecutive amino acid sequence of a full-length NRPB9A/NRPD9A/NRPE9A protein. In some embodiments, NRPB9A/NRPD9A/NRPE9A protein fragments may include sequences with one or more amino acids replaced/substituted with an amino acid different from the endogenous amino acid present at a given amino acid position in a consecutive amino acid sequence of a full-length NRPB9A/NRPD9A/NRPE9A protein. In some embodiments, NRPB9A/NRPD9A/NRPE9A protein fragments may include sequences with one or more amino acids added to an otherwise consecutive amino acid sequence of a full-length NRPB9A/NRPD9A/NRPE9A protein.

Suitable NRPB9A/NRPD9A/NRPE9A proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable NRPB9A/NRPD9A/NRPE9A proteins may include, for example, those listed in Table 24, homologs thereof, and orthologs thereof.

TABLE 24

NRPB9A/NRPD9A/NRPE9A Proteins

| Organism | Gene Name | SEQ ID NO. |
|---|---|---|
| Arabidopsis thaliana | Q6NLH0 | 337 |
| Arabidopsis lyrata | XP_002883036 | 338 |
| Cucumis melo | XP_008438942 | 339 |
| Vitis vinifera | XP_002276956 | 340 |
| Medicago truncatula | XP_003594777 | 341 |
| Ricinus communis | XP_002519205 | 342 |
| Glycine max | NP_001235803 | 343 |
| Zea mays | NP_001150634 | 344 |
| Sorghum bicolor | XP_002443356 | 345 |
| Oryza sativa | ABA98929 | 346 |
| Brachypodium distachyon | XP_003579291 | 347 |
| Populus trichocarpa | XP_002312337 | 348 |
| Brassica napus | CDX86852 | 349 |

In some embodiments, an NRPB9A/NRPD9A/NRPE9A protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB9A/NRPD9A/NRPE9A protein (SEQ ID NO: 337).

An NRPB9A/NRPD9A/NRPE9A-like protein may include the amino acid sequence or a fragment thereof of any NRPB9A/NRPD9A/NRPE9A homolog or ortholog, such as any one of those listed in Table 24. One of skill would readily recognize that additional NRPB9A/NRPD9A/NRPE9A homologs and/or orthologs may exist and may be used herein.

NRPB9B NRPD9B NRPE9B Proteins

Certain aspects of the present disclosure relate to NRPB9B/NRPD9B/NRPE9B-like proteins. In some embodiments, an NRPB9B/NRPD9B/NRPE9B-like protein refers to a recombinant NRPB9B/NRPD9B/NRPE9B protein or fragment thereof and that contains a heterologous DNA-binding domain. In some embodiments, an NRPB9B/NRPD9B/NRPE9B-like protein refers to a recombinant NRPB9B/NRPD9B/NRPE9B protein or fragment thereof that is fused to a CAS9 protein or fragment thereof. In some embodiments, an NRPB9B/NRPD9B/NRPE9B-like protein refers to a recombinant NRPB9B/NRPD9B/NRPE9B protein or fragment thereof that is fused to an MS2 coat protein or fragment thereof. In some embodiments, an NRPB9B/NRPD9B/NRPE9B-like protein refers to a recombinant NRPB9B/NRPD9B/NRPE9B protein or fragment thereof that is fused to an scFV antibody or fragment thereof. NRPB9B/NRPD9B/NRPE9B-like proteins may be used in reducing the expression of one or more target nucleic acids, such as genes, in plants.

NRPB9B/NRPD9B/NRPE9B proteins are known in the art and are described herein. NRPB9B, NRPD9B, and NRPE9B are alternative names for the same protein, as is readily understood in the art. NRPB9B/NRPD9B/NRPE9B proteins encode a subunit of RNA Polymerases II, IV, and V. In some embodiments, an NRPB9B/NRPD9B/NRPE9B protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length NRPB9B/NRPD9B/NRPE9B protein. In some embodiments, NRPB9B/NRPD9B/NRPE9B protein fragments may include sequences with one or more amino acids removed from the consecutive amino acid sequence of a full-length NRPB9B/NRPD9B/NRPE9B protein. In some embodiments, NRPB9B/NRPD9B/NRPE9B protein fragments may include sequences with one or more amino acids replaced/substituted with an amino acid different from the endogenous amino acid present at a given amino acid position in a consecutive amino acid sequence of a full-length NRPB9B/NRPD9B/NRPE9B protein. In some embodiments, NRPB9B/NRPD9B/NRPE9B protein fragments may include sequences with one or more amino acids added to an otherwise consecutive amino acid sequence of a full-length NRPB9B/NRPD9B/NRPE9B protein.

Suitable NRPB9B/NRPD9B/NRPE9B proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable NRPB9B/NRPD9B/NRPE9B proteins may include, for example, those listed in Table 25, homologs thereof, and orthologs thereof.

TABLE 25

NRPB9B/NRPD9B/NRPE9B Proteins

| Organism | Gene Name | SED ID NO. |
|---|---|---|
| Arabidopsis thaliana | Q8L5V0 | 350 |
| Arabidopsis lyrata | XP_002883036 | 351 |
| Cucumis melo | XP_008438942 | 352 |
| Vitis vinifera | XP_002276956 | 353 |

TABLE 25-continued

NRPB9B/NRPD9B/NRPE9B Proteins

| Organism | Gene Name | SED ID NO. |
|---|---|---|
| Medicago truncatula | XP_003594777 | 354 |
| Ricinus communis | XP_002519205 | 355 |
| Glycine max | NP_001235803 | 356 |
| Zea mays | NP_001150634 | 357 |
| Sorghum bicolor | XP_002443356 | 358 |
| Oryza sativa | ABA98929 | 359 |
| Brachypodium distachyon | XP_003559043 | 360 |
| Populus trichocarpa | XP_002312337 | 361 |
| Brassica napus | CDX99562 | 362 |

In some embodiments, an NRPB9B/NRPD9B/NRPE9B protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* NRPB9B/NRPD9B/NRPE9B protein (SEQ ID NO: 350).

An NRPB9B/NRPD9B/NRPE9B-like protein may include the amino acid sequence or a fragment thereof of any NRPB9B/NRPD9B/NRPE9B homolog or ortholog, such as any one of those listed in Table 25. One of skill would readily recognize that additional NRPB9B/NRPD9B/NRPE9B homologs and/or orthologs may exist and may be used herein.

SUVH2 Proteins

Certain aspects of the present disclosure relate to SUVH2-like proteins. In some embodiments, a SUVH2-like protein refers to a recombinant SUVH2 protein or fragment thereof and that contains a heterologous DNA-binding domain. In some embodiments, a SUVH2-like protein refers to a recombinant SUVH2 protein or fragment thereof that is fused to a CAS9 protein or fragment thereof. In some embodiments, a SUVH2-like protein refers to a recombinant SUVH2 protein or fragment thereof that is fused to an MS2 coat protein or fragment thereof. In some embodiments, a SUVH2-like protein refers to a recombinant SUVH2 protein or fragment thereof that is fused to an scFV antibody or fragment thereof. SUVH2-like proteins may be used in reducing the expression of one or more target nucleic acids, such as genes, in plants.

SUVH2 proteins are known in the art and are described herein. In some embodiments, a SUVH2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SUVH2 protein. In some embodiments, SUVH2 protein fragments may include sequences with one or more amino acids removed from the consecutive amino acid sequence of a full-length SUVH2 protein. In some embodiments, SUVH2 protein fragments may include sequences with one or more amino acids replaced/substituted with an amino acid different from the endogenous amino acid present at a given amino acid position in a consecutive amino acid sequence of a full-length SUVH2 protein. In some embodiments, SUVH2 protein fragments may include sequences with one or more amino acids added to an otherwise consecutive amino acid sequence of a full-length SUVH2 protein.

Suitable SUVH2 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor,* and *Oryza sativa*. Examples of suitable SUVH2 proteins may include, for example, those listed in Table 26, homologs thereof, and orthologs thereof.

TABLE 26

SUVH2 Proteins

| Organism | Gene Name | SEQ ID NO. |
|---|---|---|
| Arabidopsis thaliana | NP_180887.1 | 504 |
| Ricinus communis | XP_002528332.1 | 505 |
| Glycine max | XP_003530311.1 | 506 |
| Zea mays | DAA60407.1 | 507 |
| Medicago truncatula | XP_003619209.1 | 508 |
| Physcomitrella patens | XP_001753516.1 | 509 |
| Sorghum bicolor | XP_002459773.1 | 510 |
| Oryza sativa | EAZ03669.1 | 511 |
| Brachypodium distachyon | XP_003563196.1 | 512 |
| Populus trichocarpa | XP_002315593.1 | 513 |
| Vitis vinifera | XP_002282386.1 | 514 |
| Cucumis sativus | XP_004134031.1 | 515 |
| Arabidopsis lyrata | XP_002879445.1 | 516 |

In some embodiments, a SUVH2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVH2 protein (SEQ ID NO: 504).

A SUVH2-like protein may include the amino acid sequence or a fragment thereof of any SUVH2 homolog or ortholog, such as any one of those listed in Table 26. One of skill would readily recognize that additional SUVH2 homologs and/or orthologs may exist and may be used herein.

SUVH9 Proteins

Certain aspects of the present disclosure relate to SUVH9-like proteins. In some embodiments, a SUVH9-like protein refers to a recombinant SUVH9 protein or fragment thereof and that contains a heterologous DNA-binding domain. In some embodiments, a SUVH9-like protein refers to a recombinant SUVH9 protein or fragment thereof that is fused to a CAS9 protein or fragment thereof. In some embodiments, a SUVH9-like protein refers to a recombinant SUVH9 protein or fragment thereof that is fused to an MS2 coat protein or fragment thereof. In some embodiments, a SUVH9-like protein refers to a recombinant SUVH9 protein or fragment thereof that is fused to an scFV antibody or fragment thereof. SUVH9-like proteins may be used in reducing the expression of one or more target nucleic acids, such as genes, in plants.

SUVH9 proteins are known in the art and are described herein. In some embodiments, a SUVH9 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SUVH9 protein. In some embodiments, SUVH9 protein fragments may include sequences with one or more amino acids removed from the consecutive amino acid sequence of a full-length SUVH9 protein. In some embodiments, SUVH9 protein fragments may include sequences with one or more amino acids replaced/substituted with an amino acid different from the endogenous amino acid present at a given amino acid position in a consecutive amino acid sequence of a full-length SUVH9 protein. In some embodiments, SUVH9 protein fragments may include sequences with one or more amino acids added to an otherwise consecutive amino acid sequence of a full-length SUVH9 protein.

Suitable SUVH9 proteins may be identified and isolated from monocot and dicot plants. Examples of such plants may include, for example, *Arabidopsis* spp., *Ricinus communis, Glycine max, Zea Mays, Medicago truncatula, Physcomitrella patens, Sorghum bicolor,* and *Oryza sativa*. Examples of suitable SUVH9 proteins may include, for example, those listed in Table 27, homologs thereof, and orthologs thereof.

TABLE 27

SUVH9 Proteins

| Organism | Gene Name | SEQ ID NO: |
|---|---|---|
| Arabidopsis thaliana | AF344452.1 | 517 |
| Ricinus communis | XP_002528332.1 | 518 |
| Glycine max | XP_003530311.1 | 519 |
| Zea mays | DAA60407.1 | 520 |
| Medicago truncatula | XP_003619209.1 | 521 |
| Physcomitrella patens | XP_001753516.1 | 522 |
| Sorghum bicolor | XP_002459773.1 | 523 |
| Oryza sativa | EAZ03669.1 | 524 |
| Brachypodium distachyon | XP_003563196.1 | 525 |
| Populus trichocarpa | XP_002315593.1 | 526 |
| Vitis vinifera | XP_002282386.1 | 527 |
| Cucumis sativus | XP_004134031.1 | 528 |
| Arabidopsis lyrata | XP_002863127.1 | 529 |

In some embodiments, a SUVH9 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVH9 protein (SEQ ID NO: 517).

A SUVH9-like protein may include the amino acid sequence or a fragment thereof of any SUVH9 homolog or ortholog, such as any one of those listed in Table 27. One of skill would readily recognize that additional SUVH9 homologs and/or orthologs may exist and may be used herein.

SUVH2 and SUVH9 proteins of the present disclosure are SU-VAR(3-9) Homologs. Full-length SUVH2 and SUVH9 proteins contain a two-helix bundle domain towards the N-terminus, a SRA domain, and the pre-SET and SET domains towards the C-terminus. The structural and sequence features of the SUVH domains are known in the art and are provided herein. In some embodiments, SUVH2-like proteins and/or SUVH9-like proteins of the present disclosure may contain one or more of the canonical SUVH domains including a two-helix bundle domain, a SRA domain, a pre-SET domain, and/or a SET domain.

DMS3 Proteins

Certain aspects of the present disclosure relate to DMS3-like proteins. In some embodiments, a DMS3-like protein refers to a recombinant DMS3 protein or fragment thereof and that contains a heterologous DNA-binding domain. In some embodiments, a DMS3-like protein refers to a recombinant DMS3 protein or fragment thereof that is fused to a CAS9 protein or fragment thereof. In some embodiments, a DMS3-like protein refers to a recombinant DMS3 protein or fragment thereof that is fused to an MS2 coat protein or fragment thereof. In some embodiments, a DMS3-like protein refers to a recombinant DMS3 protein or fragment thereof that is fused to an scFV antibody or fragment thereof. DMS3-like proteins may be used in reducing the expression of one or more target nucleic acids, such as genes, in plants.

DMS3 proteins are known in the art and are described herein. In some embodiments, a DMS3 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DMS3 protein. In some embodiments, DMS3 protein fragments may include sequences with one or more amino acids removed from the consecutive amino acid sequence of a full-length DMS3 protein. In some embodiments, DMS3 protein fragments may include sequences with one or more amino acids replaced/substituted with an amino acid different from the endogenous amino acid present at a given amino acid position in a consecutive amino acid sequence of a full-length DMS3 protein. In some embodiments, DMS3 protein fragments may include sequences with one or more amino acids added to an otherwise consecutive amino acid sequence of a full-length DMS3 protein.

Suitable DMS3 proteins may be identified and isolated from monocot and dicot plants. Examples of such plants may include, for example, *Arabidopsis* spp., *Ricinus communis*, *Glycine max*, *Zea Mays*, *Medicago truncatula*, *Physcomitrella patens*, *Sorghum bicolor*, and *Oryza sativa*. Examples of suitable DMS3 proteins may include, for example, those listed in Table 28, homologs thereof, and orthologs thereof.

TABLE 28

DMS3 Proteins

| Organism | Gene Name | SEQ ID NO: |
|---|---|---|
| *Arabidopsis thaliana* | DMS3 | 531 |
| *Solanum lycopersicum* | XP_004234924.1 | 532 |
| *Solanum tuberosum* | XP_006350630.1 | 533 |
| *Phaseolus vulgaris* | ESW19314.1 | 534 |
| *Vitis vinifera* | XP_002277586.1 | 535 |
| *Theobroma cacao* | EOY23566.1 | 536 |
| *Glycine max* | XP_003550866.1 | 537 |
| *Oriza sativa Japonica* group | NP_001042520.1 | 538 |
| *Oriza sativa Indica* group | EEC70256.1 | 539 |
| *Zea mays* | NP_001132336.1 | 540 |
| *Sorghum bicolor* | XP_002454876.1 | 541 |

In some embodiments, a DMS3 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DMS3 protein (SEQ ID NO: 531).

A DMS3-like protein may include the amino acid sequence or a fragment thereof of any DMS3 homolog or ortholog, such as, for example, any one of those listed in Table 28. One of skill would readily recognize that additional DMS3 homologs and/or orthologs may exist and may be used herein.

MORC6 Proteins

Certain aspects of the present disclosure relate to MORC6-like proteins. In some embodiments, a MORC6-like protein refers to a recombinant MORC6 protein or fragment thereof and that contains a heterologous DNA-binding domain. In some embodiments, a MORC6-like protein refers to a recombinant MORC6 protein or fragment thereof that is fused to a CAS9 protein or fragment thereof. In some embodiments, a MORC6-like protein refers to a recombinant MORC6 protein or fragment thereof that is fused to an MS2 coat protein or fragment thereof. In some embodiments, a MORC6-like protein refers to a recombinant MORC6 protein or fragment thereof that is fused to an scFV antibody or fragment thereof. MORC6-like proteins may be used in reducing the expression of one or more target nucleic acids, such as genes, in plants.

MORC6 proteins are known in the art and are described herein. In some embodiments, a MORC6 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length MORC6 protein. In some embodiments, MORC6 protein fragments may include sequences with one or more amino acids removed from the consecutive amino acid sequence of a full-length MORC6 protein. In some embodiments, MORC6 protein fragments may include sequences with one or more amino acids replaced/substituted with an amino acid different from the endogenous amino acid present at a given amino acid position in a consecutive amino acid sequence of a full-length MORC6 protein. In some embodiments, MORC6 protein fragments may include sequences with one or more amino acids added to an otherwise consecutive amino acid sequence of a full-length MORC6 protein.

Suitable MORC6 proteins may be identified and isolated from monocot and dicot plants. Examples of such plants may include, for example, Arabidopsis spp., Ricinus communis, Glycine max, Zea Mays, Medicago truncatula, Physcomitrella patens, Sorghum bicolor, and Oryza sativa. Examples of suitable MORC6 proteins may include, for example, those listed in Table 29, homologs thereof, and orthologs thereof.

TABLE 29

MORC6 Proteins

| Organism | Gene Name | SEQ ID NO: |
|---|---|---|
| Arabidopsis thaliana | MORC6 | 542 |
| Solanum lycopersicum | XP_004230214.1 | 543 |
| Solanum tuberosum | XP_006344837.1 | 544 |
| Phaseolus vulgaris | ESW10038.1 | 545 |
| Vitis vinifera | XP_002278685.1 | 546 |
| Theobroma cacao | EOY20772.1 | 547 |
| Triticum urarte | EMS64080.1 | 548 |
| Glycine max | XP_003523086.1 | 549 |
| Oriza sativa Japonica group | EEE54777.1 | 550 |
| Oriza sativa Indica group | EEC70857.1 | 551 |
| Zea mays | AFW84846.1 | 552 |
| Sorghum bicolor | XP_002455787.1 | 553 |

In some embodiments, a MORC6 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana MORC6 protein (SEQ ID NO: 542).

A MORC6-like protein may include the amino acid sequence or a fragment thereof of any MORC6 homolog or ortholog, such as, for example, any one of those listed in Table 29. One of skill would readily recognize that additional MORC6 homologs and/or orthologs may exist and may be used herein.

SUVR2 Proteins

Certain aspects of the present disclosure relate to SUVR2-like proteins. In some embodiments, a SUVR2-like protein refers to a recombinant SUVR2 protein or fragment thereof and that contains a heterologous DNA-binding domain. In some embodiments, a SUVR2-like protein refers to a recombinant SUVR2 protein or fragment thereof that is fused to a CAS9 protein or fragment thereof. In some embodiments, a SUVR2-like protein refers to a recombinant SUVR2 protein or fragment thereof that is fused to an MS2 coat protein or fragment thereof. In some embodiments, a SUVR2-like protein refers to a recombinant SUVR2 protein or fragment thereof that is fused to an scFV antibody or fragment thereof. SUVR2-like proteins may be used in reducing the expression of one or more target nucleic acids, such as genes, in plants.

SUVR2 proteins are known in the art and are described herein. In some embodiments, a SUVR2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length SUVR2 protein. In some embodiments, SUVR2 protein fragments may include sequences with one or more amino acids removed from the consecutive amino acid sequence of a full-length SUVR2 protein. In some embodiments, SUVR2 protein fragments may include sequences with one or more amino acids replaced/substituted with an amino acid different from the endogenous amino acid present at a given amino acid position in a consecutive amino acid sequence of a full-length SUVR2 protein. In some embodiments, SUVR2 protein fragments may include sequences with one or more amino acids added to an otherwise consecutive amino acid sequence of a full-length SUVR2 protein.

Suitable SUVR2 proteins may be identified and isolated from monocot and dicot plants. Examples of such plants may include, for example, Arabidopsis spp., Ricinus communis, Glycine max, Zea Mays, Medicago truncatula, Physcomitrella patens, Sorghum bicolor, and Oryza sativa. Examples of suitable SUVR2 proteins may include, for example, those listed in Table 30, homologs thereof, and orthologs thereof.

TABLE 30

SUVR2 Proteins

| Organism | Gene Name | SEQ ID NO: |
|---|---|---|
| Arabidopsis thaliana | SUVR2 | 554 |
| Solanum lycopersicum | XP_004247936.1 | 555 |
| Solanum tuberosum | XP_006358446.1 | 556 |
| Phaseolus vulgaris | ESW16847.1 | 557 |
| Vitis vinifera | XP_002270320.2 | 558 |
| Theobroma cacao | EOX94338.1 | 559 |
| Triticum urarte | EMS67506.1 | 560 |
| Glycine max | XP_003541369.1 | 561 |
| Oriza sativa Japonica group | NP_001047458.1 | 562 |
| Oriza sativa Indica group | EEC78330.1 | 563 |
| Zea mays | DAA48520.1 | 564 |
| Sorghum bicolor | XP_002445655.1 | 565 |

In some embodiments, a SUVR2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* SUVR2 protein (SEQ ID NO: 554).

A SUVR2-like protein may include the amino acid sequence or a fragment thereof of any SUVR2 homolog or ortholog, such as, for example, any one of those listed in Table 30. One of skill would readily recognize that additional SUVR2 homologs and/or orthologs may exist and may be used herein.

DRD1 Proteins

Certain aspects of the present disclosure relate to DRD1-like proteins. In some embodiments, a DRD1-like protein refers to a recombinant DRD1 protein or fragment thereof and that contains a heterologous DNA-binding domain. In some embodiments, a DRD1-like protein refers to a recombinant DRD1 protein or fragment thereof that is fused to a CAS9 protein or fragment thereof. In some embodiments, a DRD1-like protein refers to a recombinant DRD1 protein or fragment thereof that is fused to an MS2 coat protein or fragment thereof. In some embodiments, a DRD1-like protein refers to a recombinant DRD1 protein or fragment thereof that is fused to an scFV antibody or fragment thereof. DRD1-like proteins may be used in reducing the expression of one or more target nucleic acids, such as genes, in plants.

DRD1 proteins are known in the art and are described herein. In some embodiments, a DRD1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRD1 protein. In some embodiments, DRD1 protein fragments may include sequences with one or more amino acids removed from the consecutive amino acid sequence of a full-length DRD1 protein. In some embodiments, DRD1 protein fragments may include sequences with one or more amino acids replaced/substituted with an amino acid different from the endogenous amino acid present at a given amino acid position in a consecutive amino acid sequence of a full-length DRD1 protein. In some embodiments, DRD1 protein fragments may include sequences with one or more amino acids added to an otherwise consecutive amino acid sequence of a full-length DRD1 protein.

Suitable DRD1 proteins may be identified and isolated from monocot and dicot plants. Examples of such plants may include, for example, *Arabidopsis* spp., *Ricinus communis*, *Glycine max*, *Zea Mays*, *Physcomitrella patens*, *Sorghum bicolor*, and *Oryza sativa*. Examples of suitable DRD1 proteins may include, for example, those listed in Table 31, homologs thereof, and orthologs thereof.

TABLE 31

| DRD1 Proteins | | |
|---|---|---|
| Organism | Gene Name | SEQ ID NO: |
| Arabidopsis thaliana | NP_179232.1 | 566 |
| Ricinus communis | XP_002530324.1 | 567 |
| Glycine max | XP_003540522.1 | 568 |

TABLE 31-continued

| DRD1 Proteins | | |
|---|---|---|
| Organism | Gene Name | SEQ ID NO: |
| Zea mays | AFW57413.1 | 569 |
| Physcomitrella patens | XP_001752976.1 | 570 |
| Sorghum bicolor | XP_002445019.1 | 571 |
| Oryza sativa | BAC84084.1 | 572 |
| Brachypodium distachyon | XP_003571619.1 | 573 |
| Populus trichocarpa | XP_002313774.2 | 574 |
| Vitis vinifera | XP_002273814.1 | 575 |
| Cucumis sativus | XP_004170971.1 | 576 |
| Arabidopsis lyrata | XP_002884170.1 | 577 |

In some embodiments, a DRD1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRD1 protein (SEQ ID NO: 566).

A DRD1-like protein may include the amino acid sequence or a fragment thereof of any DRD1 homolog or ortholog, such as, for example, any one of those listed in Table 31. One of skill would readily recognize that additional DRD1 homologs and/or orthologs may exist and may be used herein.

RDM1 Proteins

Certain aspects of the present disclosure relate to RDM1-like proteins. In some embodiments, a RDM1-like protein refers to a recombinant RDM1 protein or fragment thereof and that contains a heterologous DNA-binding domain. In some embodiments, a RDM1-like protein refers to a recombinant RDM1 protein or fragment thereof that is fused to a CAS9 protein or fragment thereof. In some embodiments, a RDM1-like protein refers to a recombinant RDM1 protein or fragment thereof that is fused to an MS2 coat protein or fragment thereof. In some embodiments, a RDM1-like protein refers to a recombinant RDM1 protein or fragment thereof that is fused to an scFV antibody or fragment thereof. RDM1-like proteins may be used in reducing the expression of one or more target nucleic acids, such as genes, in plants.

RDM1 proteins are known in the art and are described herein. In some embodiments, a RDM1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length RDM1 protein. In some embodiments, RDM1 protein fragments may include sequences with one or more amino acids removed from the consecutive amino acid sequence of a full-length RDM1 protein. In some embodiments, RDM1 protein fragments may include sequences with one or more amino acids replaced/substituted with an amino acid different from the endogenous amino acid present at a given amino acid position in a consecutive amino acid sequence of a full-length RDM1 protein. In some embodiments, RDM1 protein fragments may include sequences with one or more amino acids added to an otherwise consecutive amino acid sequence of a full-length RDM1 protein.

Suitable RDM1 proteins may be identified and isolated from monocot and dicot plants. Examples of such plants may include, for example, *Arabidopsis* spp., *Ricinus communis, Glycine max, Zea Mays*, and *Oryza sativa*. Examples of suitable RDM1 proteins may include, for example, those listed in Table 32, homologs thereof, and orthologs thereof.

TABLE 32

RDM1 Proteins

| Organism | Gene Name | SEQ ID NO: |
|---|---|---|
| *Arabidopsis thaliana* | NP_188907.2 | 578 |
| *Ricinus communis* | XP_002517093.1 | 579 |
| *Glycine max* | NP_001237231.1 | 580 |
| *Zea mays* | NP_001170520.1 | 581 |
| *Medicago truncatula* | XP_003610752.1 | 582 |
| *Oryza sativa* | BAD38576.1 | 583 |
| *Populus trichocarpa* | XP_002311634.1 | 584 |
| *Vitis vinifera* | XP_002279112.2 | 585 |
| *Cucumis sativus* | XP_004134127.1 | 586 |
| *Arabidopsis lyrata* | XP_002883375.1 | 587 |

In some embodiments, a RDM1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* RDM1 protein (SEQ ID NO: 578).

A RDM1-like protein may include the amino acid sequence or a fragment thereof of any RDM1 homolog or ortholog, such as, for example, any one of those listed in Table 32. One of skill would readily recognize that additional RDM1 homologs and/or orthologs may exist and may be used herein.

DRM3 Proteins

Certain aspects of the present disclosure relate to DRM3-like proteins. In some embodiments, a DRM3-like protein refers to a recombinant DRM3 protein or fragment thereof and that contains a heterologous DNA-binding domain. In some embodiments, a DRM3-like protein refers to a recombinant DRM3 protein or fragment thereof that is fused to a CAS9 protein or fragment thereof. In some embodiments, a DRM3-like protein refers to a recombinant DRM3 protein or fragment thereof that is fused to an MS2 coat protein or fragment thereof. In some embodiments, a DRM3-like protein refers to a recombinant DRM3 protein or fragment thereof that is fused to an scFV antibody or fragment thereof. DRM3-like proteins may be used in reducing the expression of one or more target nucleic acids, such as genes, in plants.

DRM3 proteins are known in the art and are described herein. In some embodiments, a DRM3 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRM3 protein. In some embodiments, DRM3 protein fragments may include sequences with one or more amino acids removed from the consecutive amino acid sequence of a full-length DRM3 protein. In some embodiments, DRM3 protein fragments may include sequences with one or more amino acids replaced/substituted with an amino acid different from the endogenous amino acid present at a given amino acid position in a consecutive amino acid sequence of a full-length DRM3 protein. In some embodiments, DRM3 protein fragments may include sequences with one or more amino acids added to an otherwise consecutive amino acid sequence of a full-length DRM3 protein.

Suitable DRM3 proteins may be identified and isolated from monocot and dicot plants. Examples of such plants may include, for example, *Arabidopsis* spp., *Ricinus communis, Glycine max, Zea Mays, Physcomitrella patens, Sorghum bicolor*, and *Oryza sativa*. Examples of suitable DRM3 proteins may include, for example, those listed in Table 33, homologs thereof, and orthologs thereof.

TABLE 33

DRM3 Proteins

| Organism | Gene Name | SEQ ID NO: |
|---|---|---|
| *Arabidopsis thaliana* | NP_566573.1 | 588 |
| *Ricinus communis* | XP_002519294.1 | 589 |
| *Glycine max* | XP_006583974.1 | 590 |
| *Zea mays* | NP_001105094.1 | 591 |
| *Medicago truncatula* | XP_003609841.1 | 592 |
| *Sorghum bicolor* | XP_002468285.1 | 593 |
| *Oryza sativa* | AAT85176.1 | 594 |
| *Brachypodium distachyon* | XP_003569077.1 | 595 |
| *Populus trichocarpa* | XP_002316067.2 | 596 |
| *Vitis vinifera* | XP_002264226.1 | 597 |
| *Cucumis sativus* | XP_004138523.1 | 598 |
| *Arabidopsis lyrata* | XP_002885200.1 | 599 |

In some embodiments, a DRM3 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRM3 protein (SEQ ID NO: 588).

A DRM3-like protein may include the amino acid sequence or a fragment thereof of any DRM3 homolog or ortholog, such as, for example, any one of those listed in Table 33. One of skill would readily recognize that additional DRM3 homologs and/or orthologs may exist and may be used herein.

DRM2 Proteins

Certain aspects of the present disclosure relate to DRM2-like proteins. In some embodiments, a DRM2-like protein refers to a recombinant DRM2 protein or fragment thereof and that contains a heterologous DNA-binding domain. In some embodiments, a DRM2-like protein refers to a recombinant DRM2 protein or fragment thereof that is fused to a CAS9 protein or fragment thereof. In some embodiments, a DRM2-like protein refers to a recombinant DRM2 protein or fragment thereof that is fused to an MS2 coat protein or fragment thereof. In some embodiments, a DRM2-like protein refers to a recombinant DRM2 protein or fragment thereof that is fused to an scFV antibody or fragment thereof. DRM2-like proteins may be used in reducing the expression of one or more target nucleic acids, such as genes, in plants.

DRM2 proteins are known in the art and are described herein. In some embodiments, a DRM2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DRM2 protein. In some embodiments, DRM2 protein fragments may include sequences with one or more amino acids removed from the consecutive amino acid sequence of a full-length DRM2 protein. In some embodiments, DRM2 protein fragments may include sequences with one or more amino acids replaced/substituted with an amino acid different from the endogenous amino acid present at a given amino acid position in a consecutive amino acid sequence of a full-length DRM2 protein. In some embodiments, DRM2 protein fragments may include sequences with one or more amino acids added to an otherwise consecutive amino acid sequence of a full-length DRM2 protein.

Suitable DRM2 proteins may be identified and isolated from monocot and dicot plants. Examples of such plants may include, for example, *Arabidopsis* spp., *Nicotiana tabacum*, *Ricinus communis*, *Glycine max*, *Zea Mays*, *Physcomitrella patens*, *Sorghum bicolor*, and *Oryza sativa*. Examples of suitable DRM2 proteins may include, for example, those listed in Table 34, homologs thereof, and orthologs thereof.

TABLE 34

DRM2 Proteins

| Organism | Gene Name | SEQ ID NO: |
|---|---|---|
| Arabidopsis thaliana | NP_196966.2 | 600 |
| Ricinus communis | XP_002521449.1 | 601 |
| Glycine max | XP_003524549.1 | 602 |
| Zea mays | NP_001104977.1 | 603 |
| Medicago truncatula | XP_003618189.1 | 604 |
| Sorghum bicolor | XP_002468660.1 | 605 |
| Oryza saliva | ABF93591.1 | 606 |
| Brachypodium distachyon | XP_003575456.1 | 607 |
| Populus trichocarpa | XP_002300046.2 | 608 |
| Vitis vinifera | XP_002273972.2 | 609 |
| Cucumis sativus | XP_004141100.1 | 610 |
| Arabidopsis lyrata | XP_002873681.1 | 611 |
| Nicotiana tabacum | NP_001313186.1 | 678 |

In some embodiments, a DRM2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* DRM2 protein (SEQ ID NO: 600), or to SEQ ID NO: 678.

A DRM2-like protein may include the amino acid sequence or a fragment thereof of any DRM2 homolog or ortholog, such as, for example, any one of those listed in Table 34. One of skill would readily recognize that additional DRM2 homologs and/or orthologs may exist and may be used herein.

In some embodiments, the fragment of DRM2 is a fragment that contains the catalytic (methyltransferase) domain of DRM2. In some embodiments, the fragment is a DRM2-MTase fragment from tobacco (e.g. SEQ ID NO: 679), or a homolog or ortholog thereof. In some embodiments, a DRM2-MTase fragment of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 679.

FRG Proteins

Certain aspects of the present disclosure relate to FRG-like proteins. In some embodiments, a FRG-like protein refers to a recombinant FRG protein or fragment thereof and that contains a heterologous DNA-binding domain. In some embodiments, a FRG-like protein refers to a recombinant FRG protein or fragment thereof that is fused to a CAS9 protein or fragment thereof. In some embodiments, a FRG-like protein refers to a recombinant FRG protein or fragment thereof that is fused to an MS2 coat protein or fragment thereof. In some embodiments, a FRG-like protein refers to a recombinant FRG protein or fragment thereof that is fused to an scFV antibody or fragment thereof. FRG-like proteins may be used in reducing the expression of one or more target nucleic acids, such as genes, in plants.

FRG proteins are known in the art and are described herein. In some embodiments, a FRG protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length FRG protein. In some embodiments, FRG protein fragments may include sequences with one or more amino acids removed from the consecutive amino acid sequence of a full-length FRG protein. In some embodiments, FRG protein fragments may include sequences with one or more amino acids replaced/substituted with an amino acid different from the endogenous amino acid present at a given amino acid position in a consecutive amino acid sequence of a full-length FRG protein. In some embodiments, FRG protein fragments may include sequences with one or more amino acids added to an otherwise consecutive amino acid sequence of a full-length FRG protein.

Suitable FRG proteins may be identified and isolated from monocot and dicot plants. Examples of such plants may include, for example, *Arabidopsis* spp., *Ricinus communis, Glycine max, Zea Mays, Physcomitrella patens, Sorghum bicolor*, and *Oryza sativa*. Examples of suitable FRG proteins may include, for example, those listed in Table 35, homologs thereof, and orthologs thereof.

TABLE 35

FRG Proteins

| Organism | Gene Name | SEQ ID NO: |
|---|---|---|
| *Arabidopsis thaliana* | NP_188635.1 | 612 |
| *Ricinus communis* | XP_002513133.1 | 613 |
| *Glycine max* | XP_003555190.1 | 614 |
| *Zea mays* | AFW61101.1 | 615 |
| *Medicago truncatula* | XP_003593498.1 | 616 |
| *Physcomitrella patens* | XP_001770987.1 | 617 |
| *Sorghum bicolor* | XP_002458594.1 | 618 |
| *Oryza sativa* | NP_001061138.1 | 619 |
| *Brachypodium distachyon* | XP_003560909.1 | 620 |
| *Populus trichocarpa* | XP_002305010.2 | 621 |
| *Vitis vinifera* | XP_002267403 | 622 |
| *Cucumis sativus* | XP_004134959 | 623 |
| *Arabidopsis lyrata* | XP_002883222.1 | 624 |

In some embodiments, a FRG protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* FRG protein (SEQ ID NO: 612).

A FRG-like protein may include the amino acid sequence or a fragment thereof of any FRG homolog or ortholog, such as, for example, any one of those listed in Table 35. One of skill would readily recognize that additional FRG homologs and/or orthologs may exist and may be used herein.

ATRX Proteins

Certain aspects of the present disclosure relate to ATRX-like proteins. In some embodiments, an ATRX-like protein refers to a recombinant ATRX protein or fragment thereof and that contains a heterologous DNA-binding domain. In some embodiments, an ATRX-like protein refers to a recombinant ATRX protein or fragment thereof that is fused to a CAS9 protein or fragment thereof. In some embodiments, an ATRX-like protein refers to a recombinant ATRX protein or fragment thereof that is fused to an MS2 coat protein or fragment thereof. In some embodiments, an ATRX-like protein refers to a recombinant ATRX protein or fragment thereof that is fused to an scFV antibody or fragment thereof. ATRX-like proteins may be used in reducing the expression of one or more target nucleic acids, such as genes, in plants.

ATRX proteins are known in the art and are described herein. In some embodiments, an ATRX protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length ATRX protein. In some embodiments, ATRX protein fragments may include sequences with one or more amino acids removed from the consecutive amino acid sequence of a full-length ATRX protein. In some embodiments, ATRX protein fragments may include sequences with one or more amino acids replaced/substituted with an amino acid different from the endogenous amino acid present at a given amino acid position in a consecutive amino acid sequence of a full-length ATRX protein. In some embodiments, ATRX protein fragments may include sequences with one or more amino acids added to an otherwise consecutive amino acid sequence of a full-length ATRX protein.

Suitable ATRX proteins may be identified and isolated from monocot and dicot plants. Examples of such plants may include, for example, *Arabidopsis* spp., *Ricinus communis, Glycine max, Zea Mays, Sorghum bicolor*, and *Oryza sativa*. Examples of suitable ATRX proteins may include, for example, those listed in Table 36, homologs thereof, and orthologs thereof.

TABLE 36

ATRX Proteins

| Organism | Gene Name | SEQ ID NO: |
|---|---|---|
| *Arabidopsis thaliana* | NP_001184937 | 681 |
| *Arabidopsis lyrata* | XP_002889705 | 682 |
| *Cucumis sativus* | XP_011649017.1 | 683 |
| *Vitis vinifera* | XP_010660172.1 | 684 |
| *Medicago truncatula* | XP_003590986.2 | 685 |
| *Ricinus communis* | EEF40405.1 | 686 |
| *Glycine max* | XP_014618708.1 | 687 |
| *Zea mays* | NP_001295442.1 | 688 |
| *Sorghum bicolor* | KXG38419.1 | 689 |
| *Oryza sativa* | XP_015614509.1 | 690 |
| *Brachypodium distachyon* | XP_003571839.1 | 691 |
| *Populus trichocarpa* | XP_002319663.2 | 692 |
| *Brassica napus* | CDX95047.1 | 693 |

In some embodiments, a ATRX protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* ATRX protein (SEQ ID NO: 681).

An ATRX-like protein may include the amino acid sequence or a fragment thereof of any ATRX homolog or ortholog, such as, for example, any one of those listed in Table 36. One of skill would readily recognize that additional ATRX homologs and/or orthologs may exist and may be used herein.

MOM1 Proteins

Certain aspects of the present disclosure relate to MOM1-like proteins. In some embodiments, a MOM1-like protein refers to a recombinant MOM1 protein or fragment thereof and that contains a heterologous DNA-binding domain. In some embodiments, a MOM1-like protein refers to a recombinant MOM1 protein or fragment thereof that is fused to a CAS9 protein or fragment thereof. In some embodiments, a MOM1-like protein refers to a recombinant MOM1 protein or fragment thereof that is fused to an MS2 coat protein or fragment thereof. In some embodiments, a MOM1-like protein refers to a recombinant MOM1 protein or fragment thereof that is fused to an scFV antibody or fragment thereof. MOM1-like proteins may be used in reducing the expression of one or more target nucleic acids, such as genes, in plants.

MOM1 proteins are known in the art and are described herein. In some embodiments, an MOM1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length MOM1 protein. In some embodiments, MOM1 protein fragments may include sequences with one or more amino acids removed from the consecutive amino acid sequence of a full-length MOM1 protein. In some embodiments, MOM1 protein fragments may include sequences with one or more amino acids replaced/substituted with an amino acid different from the endogenous amino acid present at a given amino acid position in a consecutive amino acid sequence of a full-length MOM1 protein. In some embodiments, MOM1 protein fragments may include sequences with one or more amino acids added to an otherwise consecutive amino acid sequence of a full-length MOM1 protein.

Suitable MOM1 proteins may be identified and isolated from monocot and dicot plants. Examples of such plants may include, for example, *Arabidopsis* spp., *Ricinus communis, Glycine max, Zea Mays, Sorghum bicolor*, and *Oryza sativa*. Examples of suitable MOM1 proteins may include, for example, those listed in Table 37, homologs thereof, and orthologs thereof.

TABLE 37

MOM1 Proteins

| Organism | Gene Name | SEQ ID NO: |
|---|---|---|
| Arabidopsis thaliana | NP_563806.1 | 694 |
| Arabidopsis lyrata | XP_002892431.1 | 695 |
| Cucumis sativus | XP_011653950.1 | 696 |
| Vitis vinifera | XP_010651197.1 | 697 |
| Medicago truncatula | XP_013465325.1 | 698 |
| Ricinus communis | EEF32941.1 | 699 |
| Glycine max | KRH26470.1 | 700 |
| Zea mays | XP_008659422.1 | 701 |
| Sorghum bicolor | KXG19083 | 702 |
| Oryza sativa | BAS95710.1 | 703 |
| Brachypodium distachyon | KQJ86790 | 704 |
| Populus trichocarpa | XP_002318937.1 | 705 |
| Brassica napus | XP_013711471 | 706 |

In some embodiments, a MOM1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* MOM1 protein (SEQ ID NO: 694).

A MOM1-like protein may include the amino acid sequence or a fragment thereof of any MOM1 homolog or ortholog, such as, for example, any one of those listed in Table 37. One of skill would readily recognize that additional MOM1 homologs and/or orthologs may exist and may be used herein.

MORC1 Proteins

Certain aspects of the present disclosure relate to MORC1-like proteins. In some embodiments, a MORC1-like protein refers to a recombinant MORC1 protein or fragment thereof and that contains a heterologous DNA-binding domain. In some embodiments, a MORC1-like protein refers to a recombinant MORC1 protein or fragment thereof that is fused to a CAS9 protein or fragment thereof. In some embodiments, a MORC1-like protein refers to a recombinant MORC1 protein or fragment thereof that is fused to an MS2 coat protein or fragment thereof. In some embodiments, a MORC1-like protein refers to a recombinant MORC1 protein or fragment thereof that is fused to an scFV antibody or fragment thereof. MORC1-like proteins may be used in reducing the expression of one or more target nucleic acids, such as genes, in plants.

MORC1 proteins are known in the art and are described herein. In plants, MORC1 was first identified to be involved in plant disease resistance signaling (Kang H G et al, 208a, 2008b, 2010). More recently, MORC1 has been shown to be involved in gene silencing and chromatin compaction, although the mechanism of action is not well understood (Moissard, G et al, 2012, 2014, Liu Z W et al, 2014).

In some embodiments, an MORC1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length MORC1 protein. In some embodiments, MORC1 protein fragments may include sequences with one or more amino acids removed from the consecutive amino acid sequence of a full-length MORC1 protein. In some embodiments, MORC1 protein fragments may include sequences with one or more amino acids replaced/substituted with an amino acid different from the endogenous amino acid present at a given amino acid position in a consecutive amino acid sequence of a full-length MORC1 protein. In some embodiments, MORC1 protein fragments may include sequences with one or more amino acids added to an otherwise consecutive amino acid sequence of a full-length MORC1 protein.

Suitable MORC1 proteins may be identified and isolated from monocot and dicot plants. Examples of such plants may include, for example, *Arabidopsis* spp., *Ricinus communis, Glycine max, Zea Mays, Sorghum bicolor*, and *Oryza sativa*. Examples of suitable MORC1 proteins may include, for example, those listed in Table 38, homologs thereof, and orthologs thereof.

TABLE 38

MORC1 Proteins

| Organism | Gene Name | SEQ ID NO: |
|---|---|---|
| Arabidopsis thaliana | NP_568000.1 | 707 |
| Arabidopsis lyrata | XP_002867022.1 | 708 |
| Cucumis sativus | XP_011653148.1 | 709 |
| Vitis vinifera | XP_002267687.2 | 710 |
| Medicago truncatula | XP_013446369.1 | 711 |
| Ricinus communis | XP_002533659.2 | 712 |
| Glycine max | KRH69835.1 | 713 |
| Zea mays | XP_008675511.1 | 714 |
| Sorghum bicolor | KXG24418.1 | 715 |
| Oryza sativa | AAK70637.1 | 716 |
| Brachypodium distachyon | XP_003573822.1 | 717 |
| Populus trichocarpa | XP_006383149.1 | 718 |
| Brassica napus | XP_013745728.1 | 719 |

In some embodiments, a MORC1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *A. thaliana* MORC1 protein (SEQ ID NO: 707).

A MORC1-like protein may include the amino acid sequence or a fragment thereof of any MORC1 homolog or ortholog, such as, for example, any one of those listed in Table 38. One of skill would readily recognize that additional MORC1 homologs and/or orthologs may exist and may be used herein.

SssI Proteins

Certain aspects of the present disclosure relate to SssI-like proteins. In some embodiments, a SssI-like protein refers to a recombinant SssI protein or fragment thereof and that contains a heterologous DNA-binding domain. In some embodiments, a SssI-like protein refers to a recombinant SssI protein or fragment thereof that is fused to a CAS9 protein or fragment thereof. In some embodiments, a SssI-like protein refers to a recombinant SssI protein or fragment thereof that is fused to an MS2 coat protein or fragment thereof. In some embodiments, a SssI-like protein refers to a recombinant SssI protein or fragment thereof that is fused to an scFV antibody or fragment thereof. SssI-like proteins may be used in reducing the expression of one or more target nucleic acids, such as genes, in plants.

SssI proteins are known in the art and are described herein. SssI is a DNA methyltransferase from the bacteria *Spiroplasma* sp. with homologs in other bacterial species.

In some embodiments, an SssI protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, or 241 or more consecutive amino acids of a full-length SssI protein. In some embodiments, SssI protein fragments may include sequences with one or more amino acids removed from the consecutive amino acid sequence of a full-length SssI protein. In some embodiments, SssI protein fragments may include sequences with one or more amino acids replaced/substituted with an amino acid different from the endogenous amino acid present at a given amino acid position in a consecutive amino acid sequence of a full-length SssI protein. In some embodiments, SssI protein fragments may include sequences with one or more amino acids added to an otherwise consecutive amino acid sequence of a full-length SssI protein.

Suitable SssI proteins may be identified and isolated from suitable bacterial species. Examples of suitable SssI proteins may include, for example, those listed in Table 39, homologs thereof, and orthologs thereof.

TABLE 39

SssI Proteins

| Organism | Gene Name | SEQ ID NO: |
|---|---|---|
| Spiroplasma monobiae | P15840.3 | 680 |
| Mycoplasma penetrans | WP_011077318.1 | 748 |
| Acholeplasma sp. CAG: 878 | CCY28146.1 | 749 |
| Mycoplasma hyosynoviae | KDE43677.1 | 750 |
| Mesoplasma seiffertii | WP_051418436.1 | 751 |
| Clostridium diolis | WP_039773024.1 | 752 |
| Streptococcus sanguinis | WP_011837382.1 | 753 |

In some embodiments, a SssI protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the SssI protein (SEQ ID NO: 680).

A SssI-like protein may include the amino acid sequence or a fragment thereof of any SssI homolog or ortholog, such as, for example, any one of those listed in Table 39. One of skill would readily recognize that additional SssI homologs and/or orthologs may exist and may be used herein.

In some aspects, use of an SssI-like protein according to the methods of the present disclosure may result in genome-wide methylation of nucleic acids as compared to a corresponding control.

Other bacterial CpG methyltransferase enzymes may also be used in the methods and compositions of the present disclosure. Exemplary bacterial CpG methyltransferases include M.MpeI proteins, such as M.MpeI from *Mycoplasma penetrans* HF-2 (SEQ ID NO: 754).

Various other bacterial DNA cytosine methyltransferases may also be used in the methods and compositions of the present disclosure. Exemplary bacterial DNA cytosine methyltransferases include HhaI proteins, such as HhaI from *Haemophilus parahaemolyticus* (SEQ ID NO: 755). HhaI is a GCGC specific methylase.

DNMT3A Proteins

Certain aspects of the present disclosure relate to DNMT3A-like proteins. In some embodiments, a DNMT3A-like protein refers to a recombinant DNMT3A protein or fragment thereof and that contains a heterologous DNA-binding domain. In some embodiments, a DNMT3A-like protein refers to a recombinant DNMT3A protein or fragment thereof that is fused to a CAS9 protein or fragment thereof. In some embodiments, a DNMT3A-like protein refers to a recombinant DNMT3A protein or fragment thereof that is fused to an MS2 coat protein or fragment thereof. In some embodiments, a DNMT3A-like protein refers to a recombinant DNMT3A protein or fragment thereof that is fused to an scFV antibody or fragment thereof. DNMT3A-like proteins may be used in reducing the expression of one or more target nucleic acids, such as genes, in plants.

DNMT3A proteins are known in the art and are described herein. In some embodiments, an DNMT3A protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DNMT3A protein. In some embodiments, DNMT3A protein fragments may include sequences with one or more amino acids removed from the consecutive amino acid sequence of a full-length DNMT3A protein. In some embodiments, DNMT3A protein fragments may include sequences with one or more amino acids replaced/substituted with an amino acid different from the endogenous amino acid present at a given amino acid position in a consecutive amino acid sequence of a full-length DNMT3A protein. In some embodiments, DNMT3A protein fragments may include sequences with one or more amino acids added to an otherwise consecutive amino acid sequence of a full-length DNMT3A protein.

Suitable DNMT3A proteins may be identified and isolated from various species Examples of suitable DNMT3A proteins may include, for example, those listed in Table 40, homologs thereof, and orthologs thereof.

TABLE 40

DNMT3A Proteins

| Organism | Gene Name | SEQ ID NO: |
|---|---|---|
| *Mus musculus* | NP_031898.1 | 861 |
| *Homo sapiens* | NP_072046.2 | 808 |
| *Pan Paniscus* | XP_008950657 | 809 |
| *Rattus norvegicus* | NP_001003958.1 | 810 |
| *Rhinolophus sinicus* | XP_019568274.1 | 811 |
| *Equus caballus* | XP_005600228.1 | 812 |
| *Ovis aries* | XP012021398.1 | 813 |
| *Bos Taurus* | AAP75901.1 | 814 |
| *Orcinus orca* | XP_012387866.1 | 815 |
| *Ictidomys tridecemlineatus* | XP_005322636.1 | 816 |
| *Monodelphis domestica* | XP_016286174.1 | 817 |

In some embodiments, a DNMT3A protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Mus musculus* DNMT3A protein (SEQ ID NO: 861).

A DNMT3A-like protein may include the amino acid sequence or a fragment thereof of any DNMT3A homolog or ortholog, such as, for example, any one of those listed in Table 40. One of skill would readily recognize that additional DNMT3A homologs and/or orthologs may exist and may be used herein.

In some embodiments, the catalytic domain of a DNMT3A protein (e.g. SEQ ID NO: 818) may be used in a polypeptide of the present disclosure. In some embodiments, a DNMT3A polypeptide of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 818.

DNMT3L Proteins

Certain aspects of the present disclosure relate to DNMT3L-like proteins. In some embodiments, a DNMT3L-like protein refers to a recombinant DNMT3L protein or fragment thereof and that contains a heterologous DNA-binding domain. In some embodiments, a DNMT3L-like protein refers to a recombinant DNMT3L protein or fragment thereof that is fused to a CAS9 protein or fragment thereof. In some embodiments, a DNMT3L-like protein refers to a recombinant DNMT3L protein or fragment thereof that is fused to an MS2 coat protein or fragment thereof. In some embodiments, a DNMT3L-like protein refers to a recombinant DNMT3L protein or fragment thereof that is fused to an scFV antibody or fragment thereof. DNMT3L-like proteins may be used in reducing the expression of one or more target nucleic acids, such as genes, in plants.

DNMT3L proteins are known in the art and are described herein. In some embodiments, an DNMT3L protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length DNMT3L protein. In some embodiments, DNMT3L protein fragments may include sequences with one or more amino acids removed from the consecutive amino acid sequence of a full-length DNMT3L protein. In some embodiments, DNMT3L protein fragments may include sequences with one or more amino acids replaced/substituted with an amino acid different from the endogenous amino acid present at a given amino acid position in a consecutive amino acid sequence of a full-length DNMT3L protein. In some embodiments, DNMT3L protein fragments may include sequences with one or more amino acids added to an otherwise consecutive amino acid sequence of a full-length DNMT3L protein.

Suitable DNMT3L proteins may be identified and isolated from various species Examples of suitable DNMT3L proteins may include, for example, those listed in Table 41, homologs thereof, and orthologs thereof.

TABLE 41

DNMT3L Proteins

| Organism | Gene Name | SEQ ID NO: |
|---|---|---|
| Mus musculus | NP_062321.1 | 819 |
| Pan paniscus | XP_003823892.1 | 820 |
| Rattus norvegicus | NP_00103964.1 | 821 |
| Rhinolophus sinicus | XP_019601251.1 | 822 |
| Equus caballus | XP_014591962.1 | 823 |
| Ovis aries | XP_014947250.1 | 824 |
| Bos Taurus | XP_010822784.1 | 825 |
| Orcinus orca | XP_004264713.1 | 826 |
| Ictidomys tridecemlineatus | XP_005323631.1 | 827 |
| Monodelphis domestica | XP_007493361.1 | 828 |
| Homo sapiens | NP_037501.2 | 862 |

In some embodiments, a DNMT3L protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the Mus musculus DNMT3L protein (SEQ ID NO: 819).

A DNMT3L-like protein may include the amino acid sequence or a fragment thereof of any DNMT3L homolog or ortholog, such as, for example, any one of those listed in Table 41. One of skill would readily recognize that additional DNMT3L homologs and/or orthologs may exist and may be used herein.

In some embodiments, the C-terminal region of a DNMT3L protein (e.g. SEQ ID NO: 829) may be used in a polypeptide of the present disclosure. In some embodiments, a DNMT3L polypeptide of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 829.

In some embodiments, fusion proteins containing DNMT3A amino acid sequences fused with DNMT3L amino acid sequences may be used. In some embodiments, a DNMT3A-DNMT3L fusion protein of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 859.

MBD9 Proteins

Certain aspects of the present disclosure relate to MBD9-like proteins. In some embodiments, a MBD9-like protein refers to a recombinant MBD9 protein or fragment thereof and that contains a heterologous DNA-binding domain. In some embodiments, a MBD9-like protein refers to a recombinant MBD9 protein or fragment thereof that is fused to a CAS9 protein or fragment thereof. In some embodiments, a MBD9-like protein refers to a recombinant MBD9 protein or fragment thereof that is fused to an MS2 coat protein or fragment thereof. In some embodiments, a MBD9-like protein refers to a recombinant MBD9 protein or fragment thereof that is fused to an scFV antibody or fragment thereof. MBD9-like proteins may be used in reducing the expression of one or more target nucleic acids, such as genes, in plants.

Figure 41:
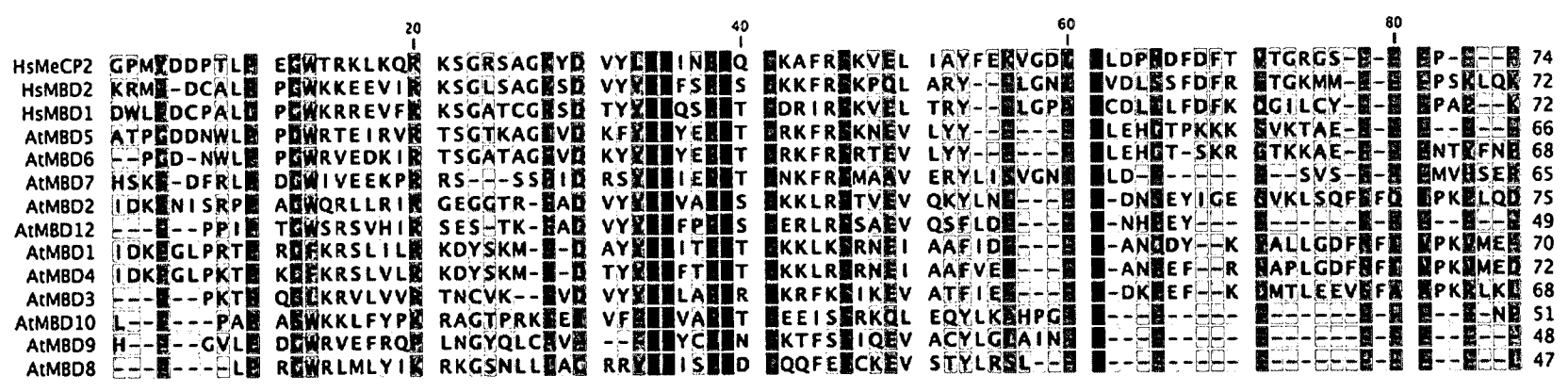

MBD9 proteins are known in the art and are described herein. FIG. 41 provides an alignment of all MBD proteins in Arabidopsis plus three from humans, and illustrates high conservation of key residues in the methyl-binding domain.

In some embodiments, an MBD9 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length MBD9 protein. In some embodiments, MBD9 protein fragments may include sequences with one or more amino acids removed from the consecutive amino acid sequence of a full-length MBD9 protein. In some embodiments, MBD9 protein fragments may include sequences with one or more amino acids replaced/substituted with an amino acid different from the endogenous amino acid present at a given amino acid position in a consecutive amino acid sequence of a full-length MBD9 protein. In some embodiments, MBD9 protein fragments may include sequences with one or more amino acids added to an otherwise consecutive amino acid sequence of a full-length MBD9 protein.

Suitable MBD9 proteins may be identified and isolated from monocot and dicot plants. Examples of such plants may include, for example, Arabidopsis spp., Ricinus communis, Glycine max, Zea Mays, Sorghum bicolor, and Oryza sativa. Examples of suitable MBD9 proteins may include, for example, those listed in Table 42, homologs thereof, and orthologs thereof.

TABLE 42

MBD9 Proteins

| Organism | Gene Name | SEQ ID NO: |
|---|---|---|
| Arabidopsis thaliana | NP_186795.1 | 830 |
| Arabidopsis lyrata | XP_002884279.1 | 831 |
| Cucumis sativus | KGN59651.1 | 832 |
| Vitis vinifera | XP_010660927.1 | 833 |
| Medicago truncatula | XP_013450825.1 | 834 |
| Ricinus communis | XP_015573615.1 | 835 |
| Glycine max | XP_006594288.1 | 836 |
| Zea mays | AQK60154.1 | 837 |
| Sorghum bicolor | KXG29684.1 | 838 |
| Oryza sativa | EEE56485.1 | 839 |
| Brachypodium distachyon | XP_003571114.3 | 840 |

TABLE 42-continued

MBD9 Proteins

| Organism | Gene Name | SEQ ID NO: |
|---|---|---|
| Populus trichocarpa | XP_002324010.2 | 841 |
| Brassica napus | CDY28674.1 | 842 |

In some embodiments, a MBD9 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the A. thaliana MBD9 protein (SEQ ID NO: 830).

A MBD9-like protein may include the amino acid sequence or a fragment thereof of any MBD9 homolog or ortholog, such as, for example, any one of those listed in Table 42. One of skill would readily recognize that additional MBD9 homologs and/or orthologs may exist and may be used herein.

Other Epigenetic Regulators

Various other epigenetic regulators may be used according to the methods of the present disclosure to target and silence a specific nucleic acid. Other exemplary proteins include DCL3 and SPT5L. DCL3 encodes a ribonuclease III family protein. An exemplary DCL3 protein includes, using A. thaliana as an exemplary host plant, SEQ ID NO: 391. SPT5L is a member of the nuclear SPT5 (Suppressor of Ty insertion 5) RNA polymerase (RNAP) elongation factor family. An exemplary SPT5L protein includes, using A. thaliana as an exemplary host plant, SEQ ID NO: 392. These proteins, as well as homologs and orthologs thereof, may also be used in the methods and compositions of the present disclosure to target and silence a specific nucleic acid as described herein for any other epigenetic regulator-like protein (e.g. AGO4-like proteins).

Other exemplary epigenetic regulators that may be used according to the methods of the present disclosure to target and silence a specific nucleic acid include, for example, DMS4, HEN1, SWI3B, DRB3 and other HYL1 homologs, DRH1 (At3g01540), DRH2 (At5g14610), UBP26, LDL1, LDL2, RDM16, SR45, STA1, KYP, MET1, VIM1 and other VIM homologs, STRS1, STRS2, ATRX, CHR25, CHR8, MOM1, MOM2 (At2g28240), STP4-1 (At5g08565), SPT4-2 (At5g63760), NRPE1, CMT3, CLSY1, IDN2, RDR6, DDM1, HDA8 and homologs and orthologs thereof.

Further, the bacterial CG specific methylase protein, SssI (SEQ ID NO: 680), may also be used in the methods and compositions of the present disclosure, as well as homologs and orthologs thereof. The mammalian CpG methyltransferase, DNMT3A, as well as fragments and homologs thereof, may also be used herein. For example, the catalytic domain of a DNMT3A polypeptide may be used herein (e.g. SEQ ID NO: 807). DNMT3L, as well as fragments and homologs thereof, may also be used herein. In some embodiments, polypeptide fusions of DNMT3A and DNMT3L amino acid sequences may also be used. Exemplary fusions of DNMT3A-DNMT3L may contain the catalytic domain of a DNMT3A protein, and the C-terminal region of a DNMT3L protein. An exemplary such fusion is presented in SEQ ID NO: 859.

Recombinant Nucleic Acids Encoding Recombinant Proteins

Certain aspects of the present disclosure relate to recombinant nucleic acids encoding recombinant proteins of the present disclosure. In some embodiments, recombinant proteins of the present disclosure are recombinantly fused to a heterologous DNA-binding domain. In some embodiments, recombinant proteins of the present disclosure are recombinantly fused to a CAS9 protein. In some embodiments, recombinant proteins of the present disclosure are recombinantly fused to an MS2 coat protein. In some embodiments, recombinant proteins of the present disclosure are recombinantly fused to an scFV antibody. The recombinant proteins may be e.g. SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins.

As used herein, the terms "polynucleotide," "nucleic acid," and variations thereof shall be generic to polydeoxyribonucleotides (containing 2-deoxy-D-ribose), to polyribonucleotides (containing D-ribose), to any other type of polynucleotide that is an N-glycoside of a purine or pyrimidine base, and to other polymers containing non-nucleotidic backbones, provided that the polymers contain nucleobases in a configuration that allows for base pairing and base stacking, as found in DNA and RNA. Thus, these terms include known types of nucleic acid sequence modifications, for example, substitution of one or more of the naturally occurring nucleotides with an analog, and inter-nucleotide modifications. As used herein, the symbols for nucleotides and polynucleotides are those recommended by the IUPAC-IUB Commission of Biochemical Nomenclature.

In one aspect, the present disclosure provides a recombinant nucleic acid encoding an SHH1-like protein. In some embodiments, the recombinant nucleic acid encodes an SHH1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 1.

In one aspect, the present disclosure provides a recombinant nucleic acid encoding an SHH2-like protein. In some embodiments, the recombinant nucleic acid encodes an SHH2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 14.

In one aspect, the present disclosure provides a recombinant nucleic acid encoding an AGO4-like protein. In some embodiments, the recombinant nucleic acid encodes an AGO4 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 15.

In one aspect, the present disclosure provides a recombinant nucleic acid encoding an HDA6-like protein. In some embodiments, the recombinant nucleic acid encodes an HDA6 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 28.

In one aspect, the present disclosure provides a recombinant nucleic acid encoding an NRPD1-like protein. In some embodiments, the recombinant nucleic acid encodes an NRPD1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 41.

In one aspect, the present disclosure provides a recombinant nucleic acid encoding an NRPE1-like protein. In some embodiments, the recombinant nucleic acid encodes an NRPE1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 54.

In one aspect, the present disclosure provides a recombinant nucleic acid encoding a JMJ14-like protein. In some embodiments, the recombinant nucleic acid encodes a JMJ14 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 80.

In one aspect, the present disclosure provides a recombinant nucleic acid encoding an RDR2-like protein. In some embodiments, the recombinant nucleic acid encodes an RDR2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 132.

In one aspect, the present disclosure provides a recombinant nucleic acid encoding an NRPD2A/NRPE2-like protein. In some embodiments, the recombinant nucleic acid encodes an NRPD2A/NRPE2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 145.

In one aspect, the present disclosure provides a recombinant nucleic acid encoding an NRPB3/NRPD3/NRPE3A-like protein. In some embodiments, the recombinant nucleic acid encodes an NRPB3/NRPD3/NRPE3A polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 158.

In one aspect, the present disclosure provides a recombinant nucleic acid encoding an NRPE3B-like protein. In some embodiments, the recombinant nucleic acid encodes an NRPE3B polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 171.

In one aspect, the present disclosure provides a recombinant nucleic acid encoding an NRPB11/NRPD11/NRPE11-like protein. In some embodiments, the recombinant nucleic acid encodes an NRPB11/NRPD11/NRPE11 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 184.

In one aspect, the present disclosure provides a recombinant nucleic acid encoding an NRPB10/NRPD10/NRPE10-like protein. In some embodiments, the recombinant nucleic acid encodes an NRPB10/NRPD10/NRPE10 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 197.

In one aspect, the present disclosure provides a recombinant nucleic acid encoding an NRPB12/NRPD12/NRPE12-like protein. In some embodiments, the recombinant nucleic acid encodes an NRPB12/NRPD12/NRPE12 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 209.

In one aspect, the present disclosure provides a recombinant nucleic acid encoding an NRPB6A/NRPD6A/NRPE6A-like protein. In some embodiments, the recombinant nucleic acid encodes an NRPB6A/NRPD6A/NRPE6A polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 221.

In one aspect, the present disclosure provides a recombinant nucleic acid encoding an NRPB6B/NRPD6B/NRPE6B-like protein. In some embodiments, the recombinant nucleic acid encodes an NRPB6B/NRPD6B/NRPE6B polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 234.

In one aspect, the present disclosure provides a recombinant nucleic acid encoding an NRPB8A/NRPE8A-like protein. In some embodiments, the recombinant nucleic acid encodes an NRPB8A/NRPE8A polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 247.

In one aspect, the present disclosure provides a recombinant nucleic acid encoding an NRPB8B/NRPD8B/NRPE8B-like protein. In some embodiments, the recombinant nucleic acid encodes an NRPB8B/NRPD8B/NRPE8B polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 260.

In one aspect, the present disclosure provides a recombinant nucleic acid encoding an NRPE5-like protein. In some embodiments, the recombinant nucleic acid encodes an NRPE5 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 273.

In one aspect, the present disclosure provides a recombinant nucleic acid encoding an NRPD4/NRPE4-like protein. In some embodiments, the recombinant nucleic acid encodes an NRPD4/NRPE4 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 286.

In one aspect, the present disclosure provides a recombinant nucleic acid encoding an NRPE7-like protein. In some embodiments, the recombinant nucleic acid encodes an NRPE7 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 299.

In one aspect, the present disclosure provides a recombinant nucleic acid encoding an NRPD7-like protein. In some embodiments, the recombinant nucleic acid encodes an NRPD7 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 312.

In one aspect, the present disclosure provides a recombinant nucleic acid encoding an NRPB5/NRPD5-like protein. In some embodiments, the recombinant nucleic acid encodes an NRPB5/NRPD5 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 325.

In one aspect, the present disclosure provides a recombinant nucleic acid encoding an NRPB9A/NRPD9A/NRPE9A-like protein. In some embodiments, the recombinant nucleic acid encodes an NRPB9A/NRPD9A/NRPE9A polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 337.

In one aspect, the present disclosure provides a recombinant nucleic acid encoding an NRPB9B/NRPD9B/NRPE9B-like protein. In some embodiments, the recombinant nucleic acid encodes an NRPB9B/NRPD9B/NRPE9B polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 350.

In one aspect, the present disclosure provides a recombinant nucleic acid encoding an SUVH2-like protein. In some embodiments, the recombinant nucleic acid encodes an SUVH2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 504.

In one aspect, the present disclosure provides a recombinant nucleic acid encoding an SUVH9-like protein. In some embodiments, the recombinant nucleic acid encodes an SUVH9 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 517.

In one aspect, the present disclosure provides a recombinant nucleic acid encoding an DMS3-like protein. In some embodiments, the recombinant nucleic acid encodes an DMS3 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 531.

In one aspect, the present disclosure provides a recombinant nucleic acid encoding an MORC6-like protein. In some embodiments, the recombinant nucleic acid encodes an MORC6 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 542.

In one aspect, the present disclosure provides a recombinant nucleic acid encoding an SUVR2-like protein. In some embodiments, the recombinant nucleic acid encodes an SUVR2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 554.

In one aspect, the present disclosure provides a recombinant nucleic acid encoding an DRD1-like protein. In some embodiments, the recombinant nucleic acid encodes an DRD1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 566.

In one aspect, the present disclosure provides a recombinant nucleic acid encoding an RDM1-like protein. In some embodiments, the recombinant nucleic acid encodes an RDM1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 578.

In one aspect, the present disclosure provides a recombinant nucleic acid encoding an DRM3-like protein. In some embodiments, the recombinant nucleic acid encodes an DRM3 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 588.

In one aspect, the present disclosure provides a recombinant nucleic acid encoding an DRM2-like protein. In some embodiments, the recombinant nucleic acid encodes an DRM2 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 600.

In one aspect, the present disclosure provides a recombinant nucleic acid encoding an FRG-like protein. In some embodiments, the recombinant nucleic acid encodes an FRG polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 612.

In one aspect, the present disclosure provides a recombinant nucleic acid encoding an DRM2-MTase-like protein. In some embodiments, the recombinant nucleic acid encodes an DRM2-MTase polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 679.

In one aspect, the present disclosure provides a recombinant nucleic acid encoding an SssI-like protein. In some embodiments, the recombinant nucleic acid encodes an SssI polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 680.

In one aspect, the present disclosure provides a recombinant nucleic acid encoding an ATRX-like protein. In some embodiments, the recombinant nucleic acid encodes an ATRX polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 681.

In one aspect, the present disclosure provides a recombinant nucleic acid encoding a MOM1-like protein. In some embodiments, the recombinant nucleic acid encodes a MOM1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 694.

In one aspect, the present disclosure provides a recombinant nucleic acid encoding a MORC1-like protein. In some embodiments, the recombinant nucleic acid encodes a MORC1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 707.

In one aspect, the present disclosure provides a recombinant nucleic acid encoding a DNMT3A-like protein. In some embodiments, the recombinant nucleic acid encodes a DNMT3A polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 818.

In one aspect, the present disclosure provides a recombinant nucleic acid encoding a DNMT3L-like protein. In some embodiments, the recombinant nucleic acid encodes a DNMT3L polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 829.

In one aspect, the present disclosure provides a recombinant nucleic acid encoding a DNMT3A-DNMT3L fusion protein. In some embodiments, the recombinant nucleic acid encodes a DNMT3A-DNMT3L fusion polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 859.

In one aspect, the present disclosure provides a recombinant nucleic acid encoding a MBD9-like protein. In some embodiments, the recombinant nucleic acid encodes a MBD9 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 830.

Sequences of the polynucleotides of the present disclosure may be prepared by various suitable methods known in the art, including, for example, direct chemical synthesis or cloning. For direct chemical synthesis, formation of a polymer of nucleic acids typically involves sequential addition of 3'-blocked and 5'-blocked nucleotide monomers to the terminal 5'-hydroxyl group of a growing nucleotide chain, wherein each addition is effected by nucleophilic attack of the terminal 5'-hydroxyl group of the growing chain on the 3'-position of the added monomer, which is typically a phosphorus derivative, such as a phosphotriester, phosphoramidite, or the like. Such methodology is known to those of ordinary skill in the art and is described in the pertinent texts and literature (e.g., in Matteucci et al., (1980) Tetrahedron Lett 21:719-722; U.S. Pat. Nos. 4,500,707; 5,436,327; and 5,700,637). In addition, the desired sequences may be isolated from natural sources by splitting DNA using appropriate restriction enzymes, separating the fragments using gel electrophoresis, and thereafter, recovering the desired polynucleotide sequence from the gel via techniques known to those of ordinary skill in the art, such as utilization of polymerase chain reactions (PCR; e.g., U.S. Pat. No. 4,683,195).

The nucleic acids employed in the methods and compositions described herein may be codon optimized relative to a parental template for expression in a particular host cell. Cells differ in their usage of particular codons, and codon bias corresponds to relative abundance of particular tRNAs in a given cell type. By altering codons in a sequence so that they are tailored to match with the relative abundance of corresponding tRNAs, it is possible to increase expression of a product (e.g. a polypeptide) from a nucleic acid. Similarly, it is possible to decrease expression by deliberately choosing codons corresponding to rare tRNAs. Thus, codon optimization/deoptimization can provide control over nucleic acid expression in a particular cell type (e.g. bacterial cell, plant cell, mammalian cell, etc.). Methods of codon optimizing a nucleic acid for tailored expression in a particular cell type are well-known to those of skill in the art.

Methods of Identifying Sequence Similarity

Various methods are known to those of skill in the art for identifying similar (e.g. homologs, orthologs, paralogs, etc.) polypeptide and/or polynucleotide sequences, including phylogenetic methods, sequence similarity analysis, and hybridization methods.

Phylogenetic trees may be created for a gene family by using a program such as CLUSTAL (Thompson et al. Nucleic Acids Res. 22: 4673-4680 (1994); Higgins et al. Methods Enzymol 266: 383-402 (1996)) or MEGA (Tamura et al. *Mol. Biol. & Evo.* 24:1596-1599 (2007)). Once an initial tree for genes from one species is created, potential orthologous sequences can be placed in the phylogenetic tree and their relationships to genes from the species of interest can be determined. Evolutionary relationships may also be inferred using the Neighbor-Joining method (Saitou and Nei, *Mol. Biol. & Evo.* 4:406-425 (1987)). Homologous sequences may also be identified by a reciprocal BLAST strategy. Evolutionary distances may be computed using the Poisson correction method (Zuckerkandl and Pauling, pp. 97-166 in *Evolving Genes and Proteins*, edited by V. Bryson and H. J. Vogel. Academic Press, New York (1965)).

In addition, evolutionary information may be used to predict gene function. Functional predictions of genes can be greatly improved by focusing on how genes became similar in sequence (i.e. by evolutionary processes) rather than on the sequence similarity itself (Eisen, *Genome Res.* 8: 163-167 (1998)). Many specific examples exist in which gene function has been shown to correlate well with gene phylogeny (Eisen, *Genome Res.* 8: 163-167 (1998)). By using a phylogenetic analysis, one skilled in the art would recognize that the ability to deduce similar functions conferred by closely-related polypeptides is predictable.

When a group of related sequences are analyzed using a phylogenetic program such as CLUSTAL, closely related sequences typically cluster together or in the same clade (a group of similar genes). Groups of similar genes can also be identified with pair-wise BLAST analysis (Feng and Doolittle, *J. Mol. Evol.* 25: 351-360 (1987)). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, Bioinformatics: Sequence and Genome Analysis Cold Spring Harbor Laboratory Press, Cold Spring Harbor, N.Y., page 543 (2001)).

To find sequences that are homologous to a reference sequence, BLAST nucleotide searches can be performed with the BLASTN program, score=100, wordlength=12, to obtain nucleotide sequences homologous to a nucleotide sequence encoding a protein of the disclosure. BLAST protein searches can be performed with the BLASTX program, score=50, wordlength=3, to obtain amino acid sequences homologous to a protein or polypeptide of the disclosure. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, or PSI-BLAST, the default parameters of the respective programs (e.g., BLASTN for nucleotide sequences, BLASTX for proteins) can be used.

Methods for the alignment of sequences and for the analysis of similarity and identity of polypeptide and polynucleotide sequences are well-known in the art.

As used herein "sequence identity" refers to the percentage of residues that are identical in the same positions in the sequences being analyzed. As used herein "sequence similarity" refers to the percentage of residues that have similar biophysical/biochemical characteristics in the same positions (e.g. charge, size, hydrophobicity) in the sequences being analyzed.

Methods of alignment of sequences for comparison are well-known in the art, including manual alignment and computer assisted sequence alignment and analysis. This latter approach is a preferred approach in the present disclosure, due to the increased throughput afforded by computer assisted methods. As noted below, a variety of computer programs for performing sequence alignment are available, or can be produced by one of skill.

The determination of percent sequence identity and/or similarity between any two sequences can be accomplished using a mathematical algorithm. Examples of such mathematical algorithms are the algorithm of Myers and Miller, CABIOS 4:11-17 (1988); the local homology algorithm of Smith et al., Adv. Appl. Math. 2:482 (1981); the homology alignment algorithm of Needleman and Wunsch, J Mol. Biol. 48:443-453 (1970); the search-for-similarity-method of Pearson and Lipman, Proc. Natl. Acad. Sci. 85:2444-2448 (1988); the algorithm of Karlin and Altschul, Proc. Natl. Acad. Sci. USA 87:2264-2268 (1990), modified as in Karlin and Altschul, Proc. Natl. Acad. Sci. USA 90:5873-5877 (1993).

Computer implementations of these mathematical algorithms can be utilized for comparison of sequences to determine sequence identity and/or similarity. Such implementations include, for example: CLUSTAL in the PC/Gene program (available from Intelligenetics, Mountain View, Calif.); the AlignX program, version10.3.0 (Invitrogen, Carlsbad, Calif.) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al. Gene 73:237-244 (1988); Higgins et al. CABIOS 5:151-153 (1989); Corpet et al., Nucleic Acids Res. 16:10881-90 (1988); Huang et al. CABIOS 8:155-65 (1992); and Pearson et al., Meth. Mol. Biol. 24:307-331 (1994). The BLAST programs of Altschul et al. J. Mol. Biol. 215:403-410 (1990) are based on the algorithm of Karlin and Altschul (1990) supra.

Polynucleotides homologous to a reference sequence can be identified by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in references cited below (e.g., Sambrook et al., Molecular Cloning: A Laboratory Manual, 2nd Ed., Vol. 1-3, Cold Spring Harbor Laboratory, Cold Spring Harbor, N.Y. ("Sambrook") (1989); Berger and Kimmel, Guide to Molecular Cloning Techniques, Methods in Enzymology, vol. 152 Academic Press, Inc., San Diego, Calif. ("Berger and Kimmel") (1987); and Anderson and Young, "Quantitative Filter Hybridisation." In: Hames and Higgins, ed., Nucleic Acid Hybridisation, A Practical Approach. Oxford, TRL Press, 73-111 (1985)).

Encompassed by the disclosure are polynucleotide sequences that are capable of hybridizing to the disclosed polynucleotide sequences and fragments thereof under various conditions of stringency (see, for example, Wahl and Berger, Methods Enzymol. 152: 399-407 (1987); and Kimmel, Methods Enzymo. 152: 507-511, (1987)). Full length cDNA, homologs, orthologs, and paralogs of polynucleotides of the present disclosure may be identified and isolated using well-known polynucleotide hybridization methods.

With regard to hybridization, conditions that are highly stringent, and means for achieving them, are well known in the art. See, for example, Sambrook et al. (1989) (supra); Berger and Kimmel (1987) pp. 467-469 (supra); and Anderson and Young (1985)(supra).

Hybridization experiments are generally conducted in a buffer of pH between 6.8 to 7.4, although the rate of hybridization is nearly independent of pH at ionic strengths likely to be used in the hybridization buffer (Anderson and Young (1985)(supra)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency. As a general guideline, high stringency is typically performed at $T_m$–5° C. to $T_m$–20° C., moderate stringency at $T_m$–20° C. to $T_m$–35° C. and low stringency at $T_m$–35° C. to $T_m$–50° C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m$–25° C. for DNA-DNA duplex and $T_m$–15° C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH.

Hybridization and wash conditions that may be used to bind and remove polynucleotides with less than the desired homology to the nucleic acid sequences or their complements of the present disclosure include, for example: 6×SSC and 1% SDS at 65° C.; 50% formamide, 4×SSC at 42° C.; 0.5×SSC to 2.0×SSC, 0.1% SDS at 50° C. to 65° C.; or 0.1×SSC to 2×SSC, 0.1% SDS at 50° C.-65° C.; with a first wash step of, for example, 10 minutes at about 42° C. with about 20% (v/v) formamide in 0.1×SSC, and with, for example, a subsequent wash step with 0.2×SSC and 0.1% SDS at 65° C. for 10, 20 or 30 minutes.

For identification of less closely related homologs, wash steps may be performed at a lower temperature, e.g., 50° C. An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Wash procedures will generally employ at least two final wash steps. Additional variations on these conditions will be readily apparent to those skilled in the art (see, for example, US Patent Application No. 20010010913).

If desired, one may employ wash steps of even greater stringency, including conditions of 65° C.-68° C. in a solution of 15 mM NaCl, 1.5 mM trisodium citrate, and 0.1% SDS, or about 0.2×SSC, 0.1% SDS at 65° C. and washing twice, each wash step of 10, 20 or 30 min in duration, or about 0.1×SSC, 0.1% SDS at 65° C. and washing twice for 10, 20 or 30 min. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C.

Target Nucleic Acids of the Present Disclosure

The recombinant proteins of the present disclosure may be targeted to specific target nucleic acids to induce gene silencing. The recombinant proteins may be, for example, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins.

In some embodiments, the SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins are targeted to a specific nucleic acid via a heterologous DNA-binding domain.

In some embodiments, the SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins reduce expression of a gene of interest by being targeted to the nucleic acid by a guide RNA.

In some embodiments, the SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins silence expression of a gene of interest by inducing RNA-directed DNA methylation at the target nucleic acid.

In some embodiments, a target nucleic acid of the present disclosure is a nucleic acid that is located at any location within a target gene that provides a suitable location for reducing expression of the target gene. The target nucleic acid may be located within the coding region of a target gene or upstream or downstream thereof. Moreover, the target nucleic acid may reside endogenously in a target gene or may be inserted into the gene, e.g., heterologous, for example, using techniques such as homologous recombination. For example, a target gene of the present disclosure can be operably linked to a control region, such as a promoter, that contains a sequence that can be recognized by a crRNA/tracrRNA and/or a guide RNA of the present disclosure such that recombinant proteins of the present disclosure are targeted to that sequence. Also, the target nucleic acid may be one that is able to be bound by a DNA-binding domain that is recombinantly fused to an epigenetic regulator of the present disclosure. In this sense, a target nucleic acid of the present disclosure is targeted based on the particular nucleotide sequence in the target nucleic acid that is recognized by the targeting portion of the DNA-binding domain, or the crRNA or guide RNA that is used according to the methods of the present disclosure.

In some embodiments, the target nucleic acid is endogenous to the plant where the expression of one or more genes is reduced by an epigenetic regulator-like protein (e.g. SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/

NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins) of the present disclosure. In some embodiments, the target nucleic acid is a transgene of interest that has been inserted into a plant. Methods of introducing transgenes into plants are well known in the art. Transgenes may be inserted into plants in order to provide a production system for a desired protein, or may be added to the genetic compliment in order to modulate the metabolism of a plant.

Examples of suitable endogenous plant genes whose expression can be reduced by an epigenetic regulator-like protein of the present disclosure may include, for example, genes that prevent the enhancement of one or more desired traits and genes that prevent increased crop yields. For example, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins of the present disclosure may be used to reduce the expression of the gene GAI in plants, which would create plants that are less sensitive to gibberellin. In embodiments relating to research, an epigenetic regulator-like protein of the present disclosure may be utilized to silence the expression of an endogenous gene of interest in order to generate mutant plants in which to study the function of the gene of interest.

Examples of suitable transgenes present in plants whose expression can be reduced by an epigenetic regulator-like protein of the present disclosure may include, for example, transgenes that are not useful in certain genetic backgrounds, transgenes that are harmful in certain genetic backgrounds, and transgenes that are expressed in certain tissues that are undesirable. For example, in the case of transgenes that are expressed in certain tissues that are undesirable, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins of the present disclosure can be utilized to silence the expression of such transgenes in specific tissues at specific times by operably linking tissue specific promoters to the recombinant polypeptides of the present disclosure. In embodiments relating to research, an epigenetic regulator-like protein of the present disclosure may be utilized to dynamically study transgenes of interest by controlling the induction/silencing of the transgenes.

Suitable target nucleic acids will be readily apparent to one of skill in the art depending on the particular need or outcome. The target nucleic acid may be in e.g. a region of euchromatin (e.g. highly expressed gene), or the target nucleic acid may be in a region of heterochromatin (e.g. centromere DNA).

Plants of the Present Disclosure

Certain aspects of the present disclosure relate to plants containing one or more epigenetic regulator-like proteins that are targeted to one or more target nucleic acids in the plant and reduce the expression of the one or more target nucleic acids.

As used herein, a "plant" refers to any of various photosynthetic, eukaryotic multi-cellular organisms of the kingdom Plantae, characteristically producing embryos, containing chloroplasts, having cellulose cell walls and lacking locomotion. As used herein, a "plant" includes any plant or part of a plant at any stage of development, including seeds, suspension cultures, plant cells, embryos, meristematic regions, callus tissue, leaves, roots, shoots, gametophytes, sporophytes, pollen, microspores, and progeny thereof. Also included are cuttings, and cell or tissue cultures. As used in conjunction with the present disclosure, plant tissue includes, for example, whole plants, plant cells, plant organs, e.g., leafs, stems, roots, meristems, plant seeds, protoplasts, callus, cell cultures, and any groups of plant cells organized into structural and/or functional units.

Any plant cell may be used in the present disclosure so long as it remains viable after being transformed with a sequence of nucleic acids. Preferably, the plant cell is not adversely affected by the transduction of the necessary nucleic acid sequences, the subsequent expression of the proteins or the resulting intermediates.

As disclosed herein, a broad range of plant types may be modified to incorporate an epigenetic regulator-like protein of the present disclosure. Suitable plants that may be modified include both monocotyledonous (monocot) plants and dicotyledonous (dicot) plants.

Examples of suitable plants may include, for example, species of the Family Gramineae, including *Sorghum bicolor* and *Zea mays*; species of the genera: *Cucurbita*, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale, and Triticum.

In some embodiments, plant cells may include, for example, those from corn (Zea mays), canola (Brassica napus, Brassica rapa ssp.), Brassica species useful as sources of seed oil, alfalfa (Medicago sativa), rice (Oryza sativa), rye (Secale cereale), sorghum (Sorghum bicolor, Sorghum vulgare), millet (e.g., pearl millet (Pennisetum glaucum), proso millet (Panicum miliaceum), foxtail millet (Setaria italica), finger millet (Eleusine coracana)), sunflower (Helianthus annuus), safflower (Carthamus tinctorius), wheat (Triticum aestivum), duckweed (Lemna), soybean (Glycine max), tobacco (Nicotiana tabacum), potato (Solanum tuberosum), peanuts (Arachis hypogaea), cotton (Gossypium barbadense, Gossypium hirsutum), sweet potato (Ipomoea batatus), cassava (Manihot esculenta), coffee (Coffea spp.), coconut (Cocos nucijra), pineapple (Ananas comosus), citrus trees (Citrus spp.), cocoa (Theobroma cacao), tea (Camellia sinensis), banana (Musa spp.), avocado (Persea americana), fig (Ficus casica), guava (Psidium guajava), mango (Mangifera indica), olive (Olea europaea), papaya (Carica papaya), cashew (Anacardium occidentale), macadamia (Macadamia spp.), almond (Prunus amygdalus), sugar beets (Beta vulgaris), sugarcane (Saccharum spp.), oats, barley, vegetables, ornamentals, and conifers.

Examples of suitable vegetables plants may include, for example, tomatoes (Lycopersicon esculentum), lettuce (e.g., Lactuca sativa), green beans (Phaseolus vulgaris), lima beans (Phaseolus limensis), peas (Lathyrus spp.), and members of the genus Cucumis such as cucumber (C. sativus), cantaloupe (C. cantalupensis), and musk melon (C. melo).

Examples of suitable ornamental plants may include, for example, azalea (Rhododendron spp.), hydrangea (Macrophylla hydrangea), hibiscus (Hibiscus rosasanensis), roses (Rosa spp.), tulips (Tulipa spp.), daffodils (Narcissus spp.), petunias (Petunia hybrida), carnation (Dianthus caryophyllus), poinsettia (Euphorbiapulcherrima), and chrysanthemum.

Examples of suitable conifer plants may include, for example, loblolly pine (Pinus taeda), slash pine (Pinus elliotii), ponderosa pine (Pinus ponderosa), lodgepole pine (Pinus contorta), Monterey pine (Pinus radiata), Douglas-fir (Pseudotsuga menziesii), Western hemlock (Isuga canadensis), Sitka spruce (Picea glauca), redwood (Sequoia sempervirens), silver fir (Abies amabilis), balsam fir (Abies balsamea), Western red cedar (Thuja plicata), and Alaska yellow-cedar (Chamaecyparis nootkatensis).

Examples of suitable leguminous plants may include, for example, guar, locust bean, fenugreek, soybean, garden beans, cowpea, mungbean, lima bean, fava bean, lentils, chickpea, peanuts (Arachis sp.), crown vetch (Vicia sp.), hairy vetch, adzuki bean, lupine (Lupinus sp.), trifolium, common bean (Phaseolus sp.), field bean (Pisum sp.), clover (Melilotus sp.) Lotus, trefoil, lens, and false indigo.

Examples of suitable forage and turf grass may include, for example, alfalfa (Medicago s sp.), orchard grass, tall fescue, perennial ryegrass, creeping bent grass, and redtop.

Examples of suitable crop plants and model plants may include, for example, Arabidopsis, corn, rice, alfalfa, sunflower, canola, soybean, cotton, peanut, sorghum, wheat, tobacco, and lemna.

The plants of the present disclosure may be genetically modified in that recombinant nucleic acids have been introduced into the plants, and as such the genetically modified plants do not occur in nature. A suitable plant of the present disclosure is one capable of expressing one or more nucleic acid constructs encoding one or more recombinant proteins. The recombinant proteins encoded by the nucleic acids may be e.g. SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1 like proteins, DRM3-like proteins, DRM2-like proteins, and/or FRG-like proteins.

As used herein, the terms "transgenic plant" and "genetically modified plant" are used interchangeably and refer to a plant which contains within its genome a recombinant nucleic acid. Generally, the recombinant nucleic acid is stably integrated within the genome such that the polynucleotide is passed on to successive generations. However, in certain embodiments, the recombinant nucleic acid is transiently expressed in the plant. The recombinant nucleic acid may be integrated into the genome alone or as part of a recombinant expression cassette. "Transgenic" is used herein to include any cell, cell line, callus, tissue, plant part or plant, the genotype of which has been altered by the presence of exogenous nucleic acid including those transgenics initially so altered as well as those created by sexual crosses or asexual propagation from the initial transgenic.

"Recombinant nucleic acid" or "heterologous nucleic acid" or "recombinant polynucleotide" as used herein refers to a polymer of nucleic acids wherein at least one of the following is true: (a) the sequence of nucleic acids is foreign to (i.e., not naturally found in) a given host cell; (b) the sequence may be naturally found in a given host cell, but in an unnatural (e.g., greater than expected) amount; or (c) the sequence of nucleic acids contains two or more subsequences that are not found in the same relationship to each other in nature. For example, regarding instance (c), a recombinant nucleic acid sequence will have two or more sequences from unrelated genes arranged to make a new functional nucleic acid. Specifically, the present disclosure describes the introduction of an expression vector into a plant cell, where the expression vector contains a nucleic acid sequence coding for a protein that is not normally found in a plant cell or contains a nucleic acid coding for a protein that is normally found in a plant cell but is under the control of different regulatory sequences. With reference to the plant cell's genome, then, the nucleic acid sequence that codes for the protein is recombinant. A protein that is referred to as recombinant generally implies that it is encoded by a recombinant nucleic acid sequence which may be present in the plant cell. Recombinant proteins of the present disclosure may also be exogenously supplied directly to host cells (e.g. plant cells).

A "recombinant" polypeptide, protein, or enzyme of the present disclosure, is a polypeptide, protein, or enzyme that is encoded by a "recombinant nucleic acid" or "heterologous nucleic acid" or "recombinant polynucleotide."

In some embodiments, the genes encoding the recombinant proteins in the plant cell may be heterologous to the plant cell. In certain embodiments, the plant cell does not naturally produce the recombinant proteins, and contains heterologous nucleic acid constructs capable of expressing one or more genes necessary for producing those molecules. In certain embodiments, the plant cell does not naturally produce one or more polypeptides of the present disclosure, and is provided the one or more polypeptides through exogenous delivery of the polypeptides directly to the plant cell without the need to express a recombinant nucleic acid encoding the recombinant polypeptide in the plant cell.

Recombinant nucleic acids and/or recombinant proteins of the present disclosure may be present in host cells (e.g. plant cells). In some embodiments, recombinant nucleic acids are present in an expression vector, and the expression vector may be present in host cells (e.g. plant cells).

Expression of Recombinant Proteins in Plants

An epigenetic regulator-like protein of the present disclosure may be introduced into plant cells via any suitable methods known in the art. For example, an SHH1-like protein, an SHH2-like protein, an AGO4-like protein, an HDA6-like protein, an NRPD1-like protein, an NRPE1-like protein, a JMJ14-like protein, an RDR2-like protein, an NRPD2A/NRPE2-like protein, an NRPB3/NRPD3/NRPE3A-like protein, an NRPE3B-like protein, an NRPB11/NRPD11/NRPE11-like protein, an NRPB10/NRPD10/NRPE10-like protein, an NRPB12/NRPD12/NRPE12-like protein, an NRPB6A/NRPD6A/NRPE6A-like protein, an NRPB6B/NRPD6B/NRPE6B-like protein, an NRPB8A/NRPE8A-like protein, an NRPB8B/NRPD8B/NRPE8B-like protein, an NRPE5-like protein, an NRPD4/NRPE4-like protein, an NRPE7-like protein, an NRPD7-like protein, an NRPB5/NRPD5-like protein, an NRPB9A/NRPD9A/NRPE9A-like protein, an NRPB9B/NRPD9B/NRPE9B-like protein, an ATRX-like protein, a MOM1-like protein, a MORC1-like protein, an SssI-like protein, a DRM2-MTase-like protein, a DNMT3A-like protein, a DNMT3L-like protein, a MBD9-like protein, a SUVH2-like protein, a SUVH9-like protein, a DMS3-like protein, a MORC6-like protein, a SUVR2-like protein, a DRD1-like protein, an RDM1-like protein, a DRM3-like protein, a DRM2-like protein, and/or an FRG-like protein can be exogenously added to plant cells and the plant cells are maintained under conditions such that the epigenetic regulator-like protein is targeted to one or more target nucleic acids and reduces the expression of the target nucleic acids in the plant cells. Alternatively, a recombinant nucleic acid encoding an epigenetic regulator-like protein of the present disclosure can be expressed in plant cells and the plant cells are maintained under conditions such that the epigenetic regulator-like protein of the present disclosure is targeted to one or more target nucleic acids and reduces the expression of the target gene in the plant cells. Additionally, in some embodiments, an epigenetic regulator-like protein of the present disclosure may be transiently expressed in a plant via viral infection of the plant, or by introducing an epigenetic regulator-like protein-encoding RNA into a plant to temporarily reduce or silence the expression of a gene of interest. Methods of introducing recombinant proteins via viral infection or via the introduction of RNAs into plants are well known in the art. For example, Tobacco rattle virus (TRV) has been successfully used to introduce zinc finger nucleases in plants to cause genome modification ("Non-transgenic Genome Modification in Plant Cells", Plant Physiology 154:1079-1087 (2010)).

A recombinant nucleic acid encoding an epigenetic regulator-like protein of the present disclosure can be expressed in a plant with any suitable plant expression vector. Typical vectors useful for expression of recombinant nucleic acids in higher plants are well known in the art and include, for example, vectors derived from the tumor-inducing (Ti) plasmid of *Agrobacterium tumefaciens* (e.g., see Rogers et al., Meth. in Enzymol. (1987) 153:253-277). These vectors are plant integrating vectors in that on transformation, the vectors integrate a portion of vector DNA into the genome of the host plant. Exemplary *A. tumefaciens* vectors useful herein are plasmids pKYLX6 and pKYLX7 (e.g., see of Schardl et al., Gene (1987) 61:1-11; and Berger et al., Proc. Natl. Acad. Sci. USA (1989) 86:8402-8406); and plasmid pBI 101.2 that is available from Clontech Laboratories, Inc. (Palo Alto, Calif.).

In addition to regulatory domains, an epigenetic regulator-like protein of the present disclosure can be expressed as a fusion protein that is coupled to, for example, a maltose binding protein ("MBP"), glutathione S transferase (GST), hexahistidine, c-myc, or the FLAG epitope for ease of purification, monitoring expression, or monitoring cellular and subcellular localization.

Moreover, a recombinant nucleic acid encoding an epigenetic regulator-like protein of the present disclosure can be modified to improve expression of the recombinant protein in plants by using codon preference. When the recombinant nucleic acid is prepared or altered synthetically, advantage can be taken of known codon preferences of the intended plant host where the nucleic acid is to be expressed. For example, recombinant nucleic acids of the present disclosure can be modified to account for the specific codon preferences and GC content preferences of monocotyledons and dicotyledons, as these preferences have been shown to differ (Murray et al., Nucl. Acids Res. (1989) 17: 477-498).

In some embodiments, an epigenetic regulator-like protein of the present disclosure can be used to create functional "gene knockout" mutations in a plant by repression of the target gene expression. Repression may be of a structural gene, e.g., one encoding a protein having for example enzymatic activity, or of a regulatory gene, e.g., one encoding a protein that in turn regulates expression of a structural gene.

The present disclosure further provides expression vectors encoding an epigenetic regulator-like protein of the present disclosure (e.g. SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins). A nucleic acid sequence coding for the desired recombinant nucleic acid of the present disclosure can be used to construct a recombinant expression vector which can be introduced into the desired host cell. A recombinant expression vector will typically contain a nucleic acid encoding a recombinant protein of the present disclosure, operably linked to transcriptional initiation regulatory sequences which will direct the transcription of the nucleic acid in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter, or functional fragment thereof, can be employed to control the expression of a recombinant nucleic acid of the present disclosure in regenerated plants. The selection of the promoter used in expression vectors will determine the spatial and temporal expression pattern of the recombinant nucleic acid in the modified plant, e.g., the nucleic acid encoding the epigenetic regulator-like protein of the present disclosure is only expressed in the desired tissue or at a certain time in plant development or growth. Certain promoters will express recombinant nucleic acids in all plant tissues and are active under most environmental conditions and states of development or cell differentiation (i.e., constitutive promoters). Other promoters will express recombinant nucleic acids in specific cell types (such as leaf epidermal cells, mesophyll cells, root cortex cells) or in specific tissues or organs (roots, leaves or flowers, for example) and the selection will reflect the desired location of accumulation of the gene product. Alternatively, the selected promoter may drive expression of the recombinant nucleic acid under various inducing conditions.

Examples of suitable constitutive promoters may include, for example, the core promoter of the Rsyn7, the core CaMV 35S promoter (Odell et al., Nature (1985) 313:810-812), CaMV 19S (Lawton et al., 1987), rice actin (Wang et al., 1992; U.S. Pat. No. 5,641,876; and McElroy et al., Plant Cell (1985) 2:163-171); ubiquitin (Christensen et al., Plant Mol. Biol. (1989)12:619-632; and Christensen et al., Plant Mol. Biol. (1992) 18:675-689), pEMU (Last et al., Theor. Appl. Genet. (1991) 81:581-588), MAS (Velten et al., EMBO J. (1984) 3:2723-2730), nos (Ebert et al., 1987), Adh (Walker et al., 1987), the P- or 2'-promoter derived from T-DNA of *Agrobacterium tumefaciens*, the Smas promoter, the cinnamyl alcohol dehydrogenase promoter (U.S. Pat. No. 5,683,439), the Nos promoter, the pEmu promoter, the rubisco promoter, the GRP 1-8 promoter, and other transcription initiation regions from various plant genes known to those of skilled artisans, and constitutive promoters described in, for example, U.S. Pat. Nos. 5,608,149; 5,608,144; 5,604,121; 5,569,597; 5,466,785; 5,399,680; 5,268,463; and 5, 608,142.

Examples of suitable tissue specific promoters may include, for example, the lectin promoter (Vodkin et al., 1983; Lindstrom et al., 1990), the corn alcohol dehydrogenase 1 promoter (Vogel et al., 1989; Dennis et al., 1984), the corn light harvesting complex promoter (Simpson, 1986; Bansal et al., 1992), the corn heat shock protein promoter (Odell et al., Nature (1985) 313:810-812; Rochester et al., 1986), the pea small subunit RuBP carboxylase promoter (Poulsen et al., 1986; Cashmore et al., 1983), the Ti plasmid mannopine synthase promoter (Langridge et al., 1989), the Ti plasmid nopaline synthase promoter (Langridge et al., 1989), the *petunia* chalcone isomerase promoter (Van Tunen et al., 1988), the bean glycine rich protein 1 promoter (Keller et al., 1989), the truncated CaMV 35s promoter (Odell et al., Nature (1985) 313:810-812), the potato patatin promoter (Wenzler et al., 1989), the root cell promoter (Conkling et al., 1990), the maize zein promoter (Reina et al., 1990; Kriz et al., 1987; Wandelt and Feix, 1989; Langridge and Feix, 1983; Reina et al., 1990), the globulin-1 promoter (Belanger and Kriz et al., 1991), the α-tubulin promoter, the cab promoter (Sullivan et al., 1989), the PEPCase promoter (Hudspeth & Grula, 1989), the R gene complex-associated promoters (Chandler et al., 1989), and the chalcone synthase promoters (Franken et al., 1991).

Alternatively, the plant promoter can direct expression of a recombinant nucleic acid of the present disclosure in a specific tissue or may be otherwise under more precise environmental or developmental control. Such promoters are referred to here as "inducible" promoters. Environmental conditions that may affect transcription by inducible promoters include, for example, pathogen attack, anaerobic conditions, or the presence of light. Examples of inducible promoters include, for example, the AdhI promoter which is inducible by hypoxia or cold stress, the Hsp70 promoter which is inducible by heat stress, and the PPDK promoter which is inducible by light. Examples of promoters under developmental control include, for example, promoters that initiate transcription only, or preferentially, in certain tissues, such as leaves, roots, fruit, seeds, or flowers. An exemplary promoter is the anther specific promoter 5126 (U.S. Pat. Nos. 5,689,049 and 5,689,051). The operation of a promoter may also vary depending on its location in the genome. Thus, an inducible promoter may become fully or partially constitutive in certain locations.

Moreover, any combination of a constitutive or inducible promoter, and a non-tissue specific or tissue specific promoter may be used to control the expression of an epigenetic regulator-like protein of the present disclosure.

Both heterologous and endogenous promoters can be employed to direct expression of recombinant nucleic acids of the present disclosure. Accordingly, in certain embodiments, expression of a nucleic acid encoding an epigenetic regulator-like protein of the present disclosure is under the control of its respective endogenous promoter. In other embodiments, expression of a nucleic acid encoding an epigenetic regulator-like protein of the present disclosure is under the control of a heterologous promoter. Additionally, an endogenous gene encoding for an epigenetic regulator of the present disclosure (e.g. SHH1, SHH2, AGO4, HDA6, NRPD1, NRPE1, JMJ14, RDR2, NRPD2A/NRPE2, NRPB3/NRPD3/NRPE3A, NRPE3B, NRPB11/NRPD11/NRPE11, NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/

NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, ATRX, MOM1, MORC1, SssI, DRM2-MTase, DNMT3A, DNMT3L, MBD9, SUVH2, SUVH9, DMS3, MORC6, SUVR2, DRD1, RDM1, DRM3, DRM2, and/or FRG) can be modified using a knock-in approach, so that the modified gene will be under the control of its respective endogenous elements. Alternatively, a modified form of an entire epigenetic regulator genomic sequence may be introduced into a plant, so that the modified/recombinant gene will be under the control of its endogenous elements and the wild-type gene remains intact. Any or all of these techniques may also be combined to direct the expression of a recombinant nucleic acid of the present disclosure.

The recombinant nucleic acids of the present disclosure and/or a vector housing a recombinant nucleic acid of the present disclosure, may also contain a regulatory sequence that serves as a 3' terminator sequence. One of skill in the art would readily recognize a variety of terminators that may be used in the recombinant nucleic acids of the present disclosure. For example, a recombinant nucleic acid of the present disclosure may contain a 3' NOS terminator. Further, a native terminator from an epigenetic regulator of the present disclosure may also be used in the recombinant nucleic acids of the present disclosure.

Plant transformation protocols as well as protocols for introducing recombinant nucleic acids of the present disclosure into plants may vary depending on the type of plant or plant cell, e.g., monocot or dicot, targeted for transformation. Suitable methods of introducing recombinant nucleic acids of the present disclosure into plant cells and subsequent insertion into the plant genome include, for example, microinjection (Crossway et al., Biotechniques (1986) 4:320-334), electroporation (Riggs et al., Proc. Natl. Acad Sci. USA (1986) 83:5602-5606), *Agrobacterium*-mediated transformation (U.S. Pat. No. 5,563,055), direct gene transfer (Paszkowski et al., EMBO J. (1984) 3:2717-2722), and ballistic particle acceleration (U.S. Pat. No. 4,945,050; Tomes et al. (1995). "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin); and McCabe et al., Biotechnology (1988) 6:923-926).

Additionally, an epigenetic regulator-like protein of the present disclosure can be targeted to a specific organelle within a plant cell. Targeting can be achieved by providing the recombinant protein with an appropriate targeting peptide sequence. Examples of such targeting peptides include, for example, secretory signal peptides (for secretion or cell wall or membrane targeting), plastid transit peptides, chloroplast transit peptides, mitochondrial target peptides, vacuole targeting peptides, nuclear targeting peptides, and the like (e.g., see Reiss et al., Mol. Gen. Genet. (1987) 209(1): 116-121; Settles and Martienssen, Trends Cell Biol (1998) 12:494-501; Scott et al., J Biol Chem (2000) 10:1074; and Luque and Correas, J Cell Sci (2000) 113:2485-2495).

The modified plant may be grown into plants in accordance with conventional ways (e.g., see McCormick et al., Plant Cell. Reports (1986) 81-84.). These plants may then be grown, and pollinated with either the same transformed strain or different strains, with the resulting hybrid having the desired phenotypic characteristic. Two or more generations may be grown to ensure that the subject phenotypic characteristic is stably maintained and inherited and then seeds harvested to ensure the desired phenotype or other property has been achieved.

Methods of Reducing Gene Expression in Plants

Growing conditions sufficient for the recombinant polypeptides of the present disclosure to be expressed in the plant to be targeted to and reduce the expression of one or more target nucleic acids of the present disclosure are well known in the art and include any suitable growing conditions disclosed herein. Typically, the plant is grown under conditions sufficient to express a recombinant polypeptide of the present disclosure (e.g. SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11-like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins), and for the expressed recombinant polypeptide to be localized to the nucleus of cells of the plant in order to be targeted to and reduce the expression of the target nucleic acids. Generally, the conditions sufficient for the expression of the recombinant polypeptide will depend on the promoter used to control the expression of the recombinant polypeptide. For example, if an inducible promoter is utilized, expression of the recombinant polypeptide in a plant will require that the plant to be grown in the presence of the inducer.

As noted above, growing conditions sufficient for the recombinant polypeptides of the present disclosure to be expressed in the plant to be targeted to and reduce the expression of one or more target nucleic acids may vary depending on a number of factors (e.g. species of plant, use of inducible promoter, etc.). Suitable growing conditions may include, for example, ambient environmental conditions, standard greenhouse conditions, growth in long days under standard environmental conditions (e.g. 16 hours of light, 8 hours of dark), growth in 12 hour light: 12 hour dark day/night cycles, etc.

Various time frames may be used to observe reduction in expression and/or targeted methylation of a target nucleic acid according to the methods of the present disclosure. Plants may be observed/assayed for reduction in expression and/or targeted methylation of a target nucleic acid after, for example, about 5 days of growth, about 10 days of growth, about 15 days after growth, about 20 days after growth, about 25 days after growth, about 30 days after growth, about 35 days after growth, about 40 days after growth, about 50 days after growth, or 55 days or more of growth.

Silencing induced by targeting various recombinant proteins of the present disclosure such as, for example, SHH1-like proteins, SHH2-like proteins, AGO4-like proteins, HDA6-like proteins, NRPD1-like proteins, NRPE1-like proteins, JMJ14-like proteins, RDR2-like proteins, NRPD2A/NRPE2-like proteins, NRPB3/NRPD3/NRPE3A-like proteins, NRPE3B-like proteins, NRPB11/NRPD11/NRPE11- like proteins, NRPB10/NRPD10/NRPE10-like proteins, NRPB12/NRPD12/NRPE12-like proteins, NRPB6A/NRPD6A/NRPE6A-like proteins, NRPB6B/NRPD6B/NRPE6B-like proteins, NRPB8A/NRPD8A/NRPE8A-like proteins, NRPB8B/NRPD8B/NRPE8B-like proteins, NRPE5-like proteins, NRPD4/NRPE4-like proteins, NRPE7-like proteins, NRPD7-like proteins, NRPB5/NRPD5-like proteins, NRPB9A/NRPD9A/NRPE9A-like proteins, NRPB9B/NRPD9B/NRPE9B-like proteins, ATRX-like proteins, MOM1-like proteins, MORC1-like proteins, SssI-like proteins, DRM2-MTase-like proteins, DNMT3A-like proteins, DNMT3L-like proteins, MBD9-like proteins, SUVH2-like proteins, SUVH9-like proteins, DMS3-like proteins, MORC6-like proteins, SUVR2-like proteins, DRD1-like proteins, RDM1-like proteins, DRM3-like proteins, DRM2-like proteins, and/or FRG-like proteins, can be stable in plants even in the absence of these recombinant proteins. Accordingly, the methods of the present disclosure may allow one or more target nucleic acids in a plant to remain silenced after the recombinant polynucleotides and/or recombinant polypeptides of the present disclosure encoding epigenetic regulator-like proteins have been crossed out of the plant. For example, after targeting a particular genomic region with a recombinant protein according to the methods of the present disclosure, the silencing and DNA methylation of the targeted region may remain stable even after crossing away the transgenes or after the recombinant polypeptide is otherwise removed from the plant. It is an object of the present disclosure to provide plants having reduced expression of one or more target nucleic acids according to the methods of the present disclosure. As the methods of the present disclosure may allow one or more target nucleic acids in a plant to remain silenced after the recombinant polynucleotides of the present disclosure have been crossed out of the plant or the recombinant polypeptides are otherwise removed from the plant, the progeny plants of these plants may have reduced expression of one or more target nucleic acids even in the absence of the recombinant polypeptides or the recombinant polynucleotides that produce the recombinant polypeptides of the present disclosure.

A target nucleic acid of the present disclosure in a plant cell housing an epigenetic-regulator like protein of the present disclosure may have its level of methylation increased by at least about 5%, at least about 10%, at least about 15%, at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% as compared to a corresponding control. Various controls will be readily apparent to one of skill in the art. For example, a control may be a corresponding plant or plant cell that does not contain a nucleic acid encoding an epigenetic regulator-like protein of the present disclosure.

A target nucleic acid of the present disclosure having increased methylation as compared to a corresponding control nucleic acid may exhibit an increase in methylation over a number of nucleotides including and adjacent to the targeted nucleotide sequences in a target nucleic acid. For example, the increase in methylation may be present over one nucleotide, over about 5 nucleotides, over about 10 nucleotides, over about 15 nucleotides, over about 20 nucleotides, over about 25 nucleotides, over about 30 nucleotides, over about 35 nucleotides, over about 40 nucleotides, over about 45 nucleotides, over about 50 nucleotides, over about 55 nucleotides, over about 60 nucleotides, over about 75 nucleotides, over about 100 nucleotides, over about 125 nucleotides, over about 150 nucleotides, over about 175 nucleotides, over about 200 nucleotides, over about 225 nucleotides, over about 250 nucleotides, over about 275 nucleotides, over about 300 nucleotides, over about 350 nucleotides, over about 400 nucleotides, over about 450 nucleotides, over about 500 nucleotides, over about 600 nucleotides, over about 700 nucleotides, over about 800 nucleotides, over about 900 nucleotides, over about 1,000 nucleotides, over about 1,500 nucleotides, over about 2,000 nucleotides, over about 2,500 nucleotides, or over about 3,000 nucleotides or more as compared to corresponding nucleotides in a corresponding control nucleic acid. The increase in methylation of nucleotides adjacent to the target nucleotides in the target nucleic acid may occur in nucleotides that are 5' to the target nucleotide sequences, 3' to the target nucleotides sequences, or both 5' and 3' to the target nucleotide sequences.

A target nucleic acid of the present disclosure in a plant cell housing an epigenetic-regulator like protein of the present disclosure may have its expression reduced by at least about 5%, at least about 10%, at least about 15%, at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% as compared to a corresponding control. Various controls will be readily apparent to one of skill in the art. For example, a control may be a corresponding plant or plant cell that does not contain a nucleic acid encoding an epigenetic regulator-like protein of the present disclosure.

It is to be understood that while the present disclosure has been described in conjunction with the preferred specific embodiments thereof, the foregoing description is intended to illustrate and not limit the scope of the present disclosure. Other aspects, advantages, and modifications within the scope of the present disclosure will be apparent to those skilled in the art to which the present disclosure pertains.

EXAMPLES

The following examples are offered to illustrate provided embodiments and are not intended to limit the scope of the present disclosure.

Example 1: DNA-Binding Domain-Targeting of Epigenetic Regulators to the FWA Locus This Example demonstrates the targeting of different epigenetic regulators/components of the RNA-directed DNA methylation pathway to recruit Pol IV and/or Pol V to specific loci.

INTRODUCTION

The RNA-directed DNA methylation (RdDM) pathway mediates de novo DNA methylation in plants. Applicants have previously demonstrated the use of ZF-SUVH2 to specifically target methylation and silencing of a target locus. SUVH2 is an epigenetic regulator and is involved in the RNA-directed DNA methylation pathway. This result was achieved by utilizing the FWA gene as a target. Expression of FWA causes a strong late-flowering phenotype in *Arabidopsis*. Methylation at the promoter of this gene, as is present in wild-type plants, causes transcriptional silencing of FWA and results in an early-flowering phenotype relative to fwa-4 mutants. The fwa-4 *Arabidopsis* epigenetic mutant shows no methylation in the promoter of the FWA gene and thus shows the characteristic late-flowering phenotype (relative to wild type). Applicants constructed a chimeric SUVH2 protein fused to a Zinc Finger (ZF) protein designed to target the promoter of FWA in *Arabidopsis*, ZF108, and demonstrates that this fusion protein can promote methylation at this genomic site in fwa-4 plants (See WO/2014/134567). This methylation targeting is accompanied by the recruitment of Pol V to this (FWA) site and results in the production of the non-coding RNA needed to trigger methylation, gene silencing, and therefore produce an early-flowering phenotype.

In this Example, Applicants explored whether other epigenetic regulators could be targeted to a specific locus and induce silencing, using the FWA gene as a target locus.

Materials and Methods

Plasmid Construction

In order to create the different fusion proteins described in this example, the ZF108 fragment in the pUC57 plasmid was digested with the restriction enzyme XhoI and inserted directly into the unique XhoI site in different genes or inserted into the unique XhoI of a set of modified pCR2 plasmids containing either BLRP_3×Flag, 3×Flag_BLRP, BLRP_3×HA or 3×HA_BLRP tags, where the XhoI unique restriction site is located between the BLRP sequence and the Flag or HA tag, no matter whether Flag or HA tags are in 5' or 3' position with respect to the BLRP sequence. ZF108 contains 6 Zn fingers and was designed as described in Segal et al (Segal et al., 2003). ZF108 is designed to target the promoter of FWA in *Arabidopsis thaliana*. The sequence of ZF108 is presented in SEQ ID NO: 393. Most of the epigenetic regulator proteins described in this Example were from *A. thaliana*. In addition, the catalytic domain of DRM2 from *Nicotiana tabacum* was utilized because this domain was successfully crystalized (Cell, 157: 1050-1060). In addition, the SssI DNA methyltransferase from the bacteria *Spiroplasma* sp. was utilized (Nucleic Acids Research, 22:5354-5359).

NRPD1-3×Flag-ZF: For this purpose, the plasmid pENTR-NRPD1 (Law et al, 2011) was used that contains a genomic sequence of NRPD1 including 1450 base pairs of 5' promoter sequence. The 3×Flag-ZF108-BLRP fusion in the pCR2 plasmid was then digested with AscI and inserted by InFusion (Clontech) in the single AscI site of a pENTR-NRPD1 plasmid, located 6 base pairs after the end of the coding sequence of NRPD1.

NRPD2-3×Flag-ZF: For this purpose, the plasmid pDONR-NRPD2 (Haag, J R et al, 2009) was used that contains a genomic sequence of NRPD2 including 1300 base pairs of 5' promoter sequence. The NRPD2 sequence was introduced into the vector JP726 by LR reaction (Invitrogen) and the 3×Flag-ZF108-BLRP fusion was cloned into the unique PacI restriction site located 50 bp downstream of the end of the NRPD2 sequence.

RDR2-3×Flag-ZF: For this purpose, the plasmid pENTR-RDR2 (Law et al, 2011) was used that contains a genomic sequence of RDR2 including 300 base pairs of 5' promoter sequence. The 3×Flag-ZF108-BLRP fusion in the pCR2 plasmid was inserted in the single AscI site of a pENTR-RDR2 plasmid by InFusion (Clontech), located 6 base pairs after the end of the coding sequence of RDR2.

SHH1-3×Myc-ZF: For this purpose, the plasmid pENTR-SHH1 (Law et al, 2011) was used that contains a genomic sequence of SHH1 including 1400 base pairs of 5' promoter sequence. A 3×Myc-ZF108-BLRP fusion in the pCR2 plasmid was then inserted in the single AscI site of a pENTR-SHH1 plasmid by InFusion (Clontech), located 6 base pairs after the end of the coding sequence of SHH1. In this particular construction, a shorter ZF108 sequence with only five tandem copies of the Zn Finger repeats was cloned instead of the six tandem copies present in ZF108.

HDA6_3×Flag_ZF: For this purpose, the plasmid pEG302-HDA6 was used that contains a genomic sequence of HDA6 including 700 base pairs of 5' promoter sequence. The 3×Flag-ZF108-BLRP fusion in the pCR2 plasmid was then digested with AscI and inserted by InFusion (Clontech) in the single AscI site of a pEG302-HDA6 plasmid, located 6 base pairs after the end of the coding sequence of HDA6.

ZF-3×Flag-AGO4: For this purpose, the plasmid pCAMBIA1300a-AGO4 (Li et al, 2006) was used that contains a genomic sequence of AGO4 including 3700 base pairs of 5' promoter sequence. The BLRP-ZF108-3×Flag fusion in the pCR2 plasmid was then digested with ApaI/BamHI and inserted in the single ApaI/BamHI sites of a pCAMBIA1300a-AGO4 plasmid, located right upstream of the coding sequence of AGO4.

JMJ14-3×Flag-ZF: For this purpose, the plasmid pEG302-JMJ14 (Deleris et al, 2010) was used that contains a genomic sequence of JMJ14 including 1600 base pairs of 5' promoter sequence. The 3×Flag-ZF108-BLRP fusion in the pCR2 plasmid was then digested with AscI and inserted by InFusion (Clontech) in the single AscI sites of a pEG302-JMJ14 plasmid, located 6 base pairs after the end of the coding sequence of JMJ14.

SHH2_3×FlagZF: For this purpose, a genomic fragment of SHH2 containing 1294 bp of 5'promoter was cloned into pENTR/D (Invitrogen). The 3×Flag-ZF108-BLRP fusion in the pCR2 plasmid was then digested with AscI and inserted by InFusion (Clontech) in the single AscI site of a pENTR-SHH2 plasmid, located 6 base pairs after the end of the coding sequence of SHH2.

ZF_3×Flag_DMS3: For this purpose, a modified pMDC123 plasmid (Curtis et al, 2003, Plant Phys) was created first, containing 1990 bp of the promoter region of Arabidopis UBQ10 gene upstream of the BLRP_ZF108_3× Flag cassette present in one of the modified pCR2 plasmids described above. Both UBQ10 promoter and BLRP_ZF108_3×Flag are upstream of the gateway cassette (Invitrogen) present in the original pMDC123 plasmid. A cDNA sequence of DMS3 was cloned first into pENTR/D plasmid (Invitrogen) and then delivered into the modified pMDC123 by LR reaction (Invitrogen), creating an in-frame fusion of DMS3 cDNA with the upstream BLRP_ZF_3× Flag cassette.

pUBQ10::ZF_3×Flag_M.SssI. For this purpose, a modified pMDC123 plasmid (Curtis et al, 2003, Plant Phys) was created first, containing 1990 bp of the promoter region of *Arabidopsis* UBQ10 gene upstream of the BLRP_ZF108_3× Flag cassette present in one of the modified pCR2 plasmids described above. Both UBQ10 promoter and BLRP_ZF108_3×Flag are upstream of the gateway cassette (Invitrogen) present in the original pMDC123 plasmid. A plant codon-optimized cDNA sequence of the Methyltransferase gene from *Spiroplasma* sp. strain MQ1 (M.SssI) was cloned first into pENTR/D plasmid (Invitrogen) and then delivered into the modified pMDC123 by LR reaction (Invitrogen), creating an in-frame fusion of M.SssI cDNA with the upstream BLRP_ZF_3×Flag cassette. The nucleotide sequence of plant codon-optimized M.SssI in pUBQ10::ZF_3xFlag_M.SssI is set forth as SEQ ID NO: 661.

pUBQ10::ZF_3xFlag_NtDRM2_Mtase. For this purpose, a modified pMDC123 plasmid (Curtis et al, 2003, Plant Phys) was created first, containing 1990 bp of the promoter region of Arabidopsis UBQ10 gene upstream of the BLRP_ZF108_3xFlag cassette present in one of the modified pCR2 plasmids described above. Both UBQ10 promoter and BLRP_ZF108_3xFlag are upstream of the gateway cassette (Invitrogen) present in the original pMDC123 plasmid. A cDNA sequence of Nicotiana tabacum DRM2 methyltransferase domain (NtDRM2_Mtase) was cloned first into pENTR/D plasmid (Invitrogen) and then delivered into the modified pMDC123 by LR reaction (Invitrogen), creating an in-frame fusion of NtDRM2_Mtase cDNA with the upstream BLRP_ZF_3xFlag cassette. The nucleotide sequence of NtDRM2_Mtase in pUBQ10::ZF_3x Flag_NtDRM2_Mtase is set forth as SEQ ID NO: 670.

ZF-3xHA-SUVH9: For this purpose, the plasmid pENTR-3xHA-SUVH9 (Johnson, L et al, 2008, PLoS Genet. 2008 November; 4(11):e1000280) was used that contains a genomic sequence of SUVH9 including 1400 base pairs of 5' promoter sequence and a BLRP-3xHA epitope upstream of the start codon. The ZF108 in the pCR2 plasmid was then amplified and cloned into the unique XhoI site of pENTR-3xHA-SUVH9 plasmid. by InFusion (Clontech) creating the pENTR-BLRP-ZF108-3xHA-SUVH9 plasmid.

Plant Transformation

All ZF-108 fusion protein constructs cloned in a pENTR plasmid (see above) were recombined into the binary vector pEG302-JP726 by LR reaction (Invitrogen) except for ZF_3xFlag_DMS3, pUBQ10::ZF_3xFlag_M.SssI, pUBQ10::ZF_3xFlag_NtDRM2_Mtase that were cloned in pDMC123 and ZF-3xFlag-AGO4 that was cloned in pCAMBIA1300a. All constructs were introduced into fwa-4 plants using Agrobacterium-mediated transformation. Transformed lines were selected using BASTA, except for ZF-3xFlag-AGO4 where Hygromycin selection was done.

Flowering Time Measurements

Flowering time was measured by counting the total number of leaves (rossette and cauline) of each individual plant.

Bisulfite Sequencing and Data Analysis

Bisulfite sequencing followed by PCR amplification and cloning of FWA fragments was done using EZ DNA Methylation-Gold kit (Zymo Research) as performed in Johnson et al. (2008). BS-Seq libraries were generated as previously reported (Cokus et al., 2008) and all libraries were sequenced using the HiSeq 2000 platform following manufacturer instructions (Illumina) at a length of 50 bp. Bisulfite-Seq (BS-Seq) reads were aligned to the TAIR10 version of the Arabidopsis thaliana reference genome using BS-seeker. For BS-Seq up to 2 mismatches were allowed and only uniquely mapped reads were used.

Results

To explore whether various other RdDM proteins have the ability to trigger de novo DNA methylation at the FWA locus, or otherwise silence this locus, in the fwa-4 mutant, a series of experiments were conducted in an attempt to target different components of the RdDM pathway to the promoter of the FWA gene in Arabidopsis. Various proteins involved in RdDM were selected and were fused to the ZF108 zinc finger, which targets the FWA promoter (see Materials and Methods), and transformed into the fwa-4 mutant. ZF-targeting lines were constructed as described above. The flowering time of independent transgenic lines was scored. The list of the different RdDM components chosen and the flowering time results are shown below in Table 1A.

TABLE 1A

Early flowering in T1 lines compared to fwa-4

|          | early | late | % early |
|----------|-------|------|---------|
| SHH1_ZF  | 13    | 35   | 27      |
| SHH2_ZF  | 4     | 15   | 21      |
| ZF_AGO4  | 12    | 55   | 18      |
| HDA6_ZF  | 3     | 5    | 38      |
| NRPD1_ZF | 4     | 13   | 24      |
| JMJ14_ZF | 3     | 9    | 25      |
| RDR2_ZF  | 9     | 44   | 14      |
| NRPD2a_ZF| 4     | 24   | 14      |
| ZF_M.SssI| 12    | 16   | 42      |
| ZF_Mtase | 18    | 31   | 37      |
| ZF_SUVH9 | 3     | 6    | 33      |
| ZF       | 0     | 49   | 0       |
| 2xZF     | 0     | 11   | 0       |
| YPET_ZF  | 0     | 40   | 0       |
| YPET2x_ZF| 0     | 23   | 0       |

The results presented in Table 1A demonstrate that various epigenetic regulators fused to a zinc finger that targets the FWA locus can efficiently promote early flowering in an fwa-4 mutant background. Different proteins also demonstrated a range of ability to induce FWA silencing. HDA6_ZF had one of the highest silencing efficiencies (38%).

Figure 6:
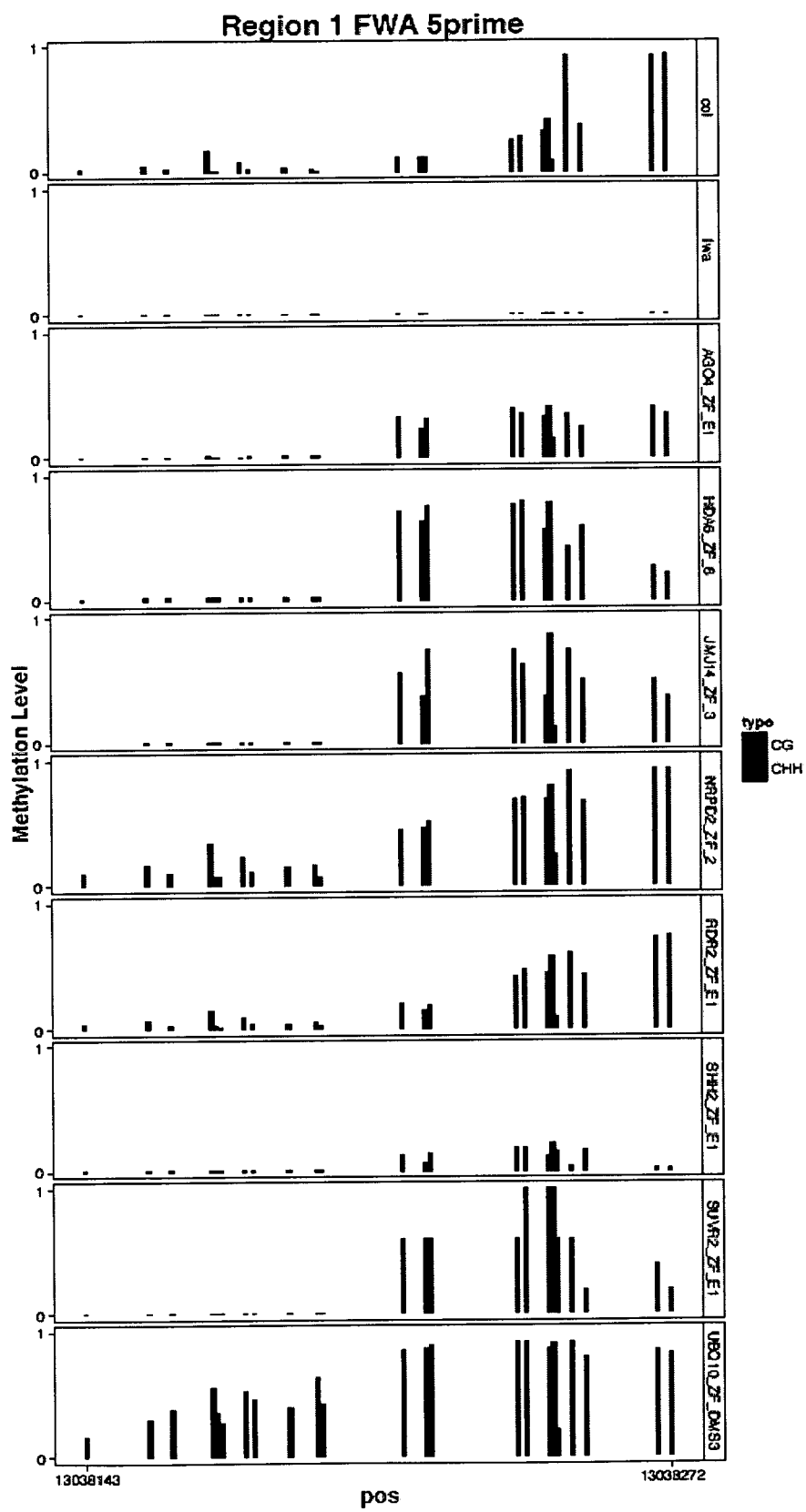
FIG. 6 illustrates bisulfite sequencing results of exemplary AGO4-ZF, HDA6-ZF, JMJ14-ZF, NRPD2-ZF, RDR2-ZF, SHH2-ZF, SUVR2-ZF, and DMS3-ZF transgenic lines in an fwa-4 mutant background that exhibited early flowering.
Figure 7A:
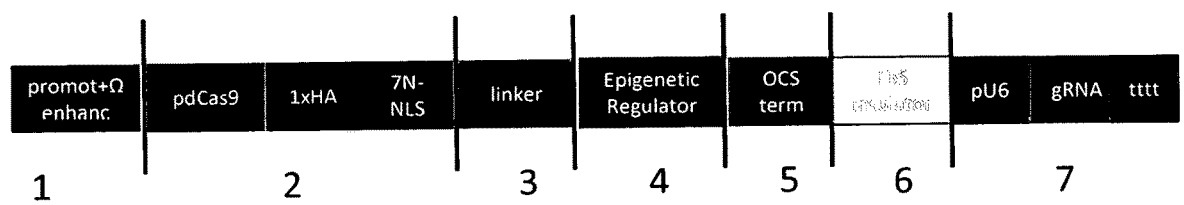
FIG. 7A illustrates the structure of an exemplary fusion construct containing an epigenetic regulator C-terminally fused to a dCAS9 protein.
Figure 7B:
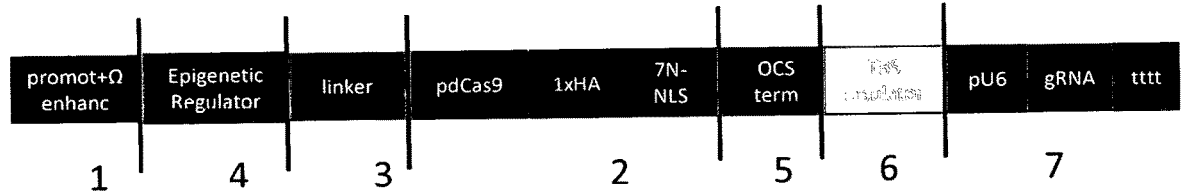
FIG. 7B illustrates the structure of an exemplary fusion construct containing an epigenetic regulator N-terminally fused to a dCAS9 protein.
Figure 8A:
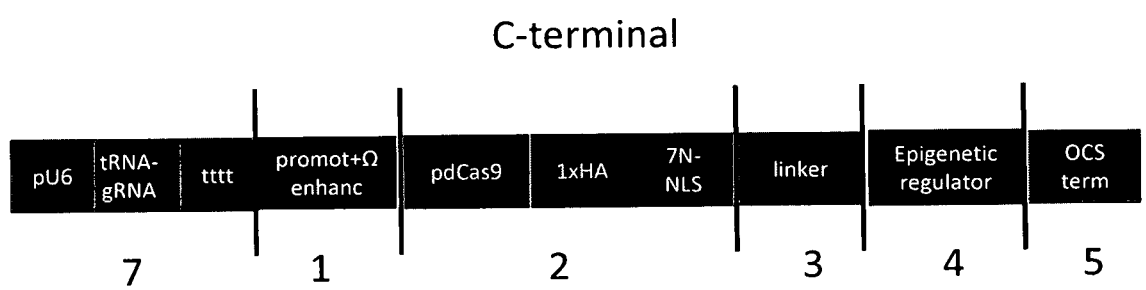
FIG. 8A illustrates the structure of an exemplary fusion construct containing an epigenetic regulator C-terminally fused to a dCAS9 protein.
Figure 8B:
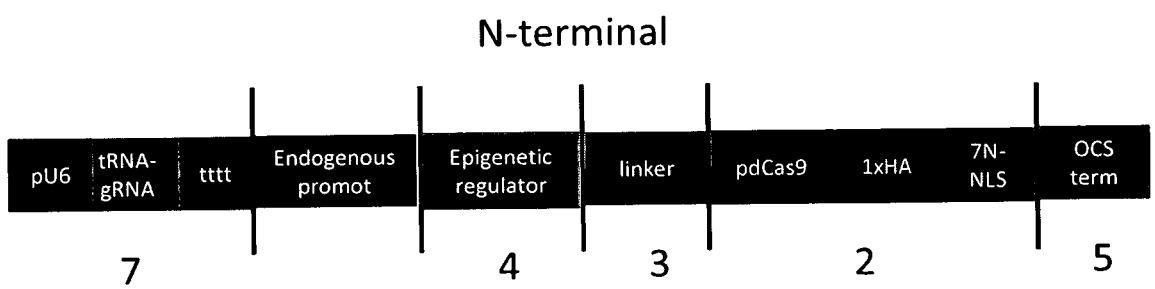
FIG. 8B illustrates the structure of an exemplary fusion construct containing an epigenetic regulator N-terminally fused to a dCAS9 protein.

In order to analyze whether the early flowering phenotype of the early-flowering lines described in Table 1A was due to the methylation of the FWA promoter, a whole-genome bisulfite sequencing assay was performed in two independent NRPD1-ZF lines that showed the early flowering phenotype relative to fwa-4. Bisulfite sequencing experiments were conducted as described above. The results, which are presented in FIG. 5, show that DNA methylation was re-established at FWA in the NRPD1-ZF lines. Thus, NRPD1 was effective in targeting methylation at the FWA promoter. Similar bisulfite sequencing results with other epigenetic regulator-ZF transgenic lines are presented in FIG. 6. These results suggest that the other epigenetic regulators described above where early flowering was observed may also be targeting DNA methylation to FWA. Regardless of the mechanism, the early flowering phenotypes observed in transgenic fwa-4 plants is evidence that FWA was silenced.

Applicants have shown that different RdDM proteins can be targeted to silence specific loci with varying degrees of silencing efficiency. There may be some advantage to having a set of proteins that can provide a range of different efficiencies of gene silencing. For example, depending on the target nucleic acid to be silenced, it may be advantageous to select recombinant proteins of the present disclosure having different silencing efficiencies. For example, it may be an advantage to fully silence the expression of a target gene by selecting a very efficient RdDM component to direct as much methylation as possible to the target gene. In other cases, it might be an advantage to target a less efficient RdDM component to target less methylation to a gene to cause only a partial silencing effect. Genes often show different effects on plant phenotype when they are expressed at different levels, and there are likely to be situations where partial silencing of a plant gene is most advantageous.

Example 2: CRISPR-targeting of Epigenetic Regulators to Specific Loci

This Example describes exemplary experimental guidelines for constructing fusion constructs containing epigenetic regulators as disclosed herein fused to dCAS9 proteins. These constructs may be used to target an epigenetic regulator to a specific locus of a genome using the CRISPR-CAS9 system.

To test whether epigenetic regulators as described herein may be targeted to a target nucleic acid using a CRISPR-CAS9 system, a series of different fusion constructs will be prepared. As the specific position of the epigenetic regulator in the fusion protein may impact function, different constructs will be prepared such that the epigenetic regulator is oriented either N-terminal or C-terminal to the position of the dCAS9 protein in the fusion protein. Different promoters will also be tested to evaluate whether certain promoters produce optimal expression levels of the fusion proteins, such as using constitutive promoters. Further, in order to ensure optimal functioning of both the dCAS9 protein and the epigenetic regulator, different linkers with different properties will be evaluated in these fusion proteins.

Materials and Methods

Cloning of Fusion Proteins and gRNA-fwa

Exemplary structures of these fusion constructs to be used in the CRISPR-CAS9 system are presented in FIG. 7A, FIG. 7, FIG. 8A, and FIG. 8B. In these figures, different regions of the construct are numerically labeled, with each region representing a respective module of the construct. Fusion constructs containing different variants of the modules presented in these figures will also be prepared, as described below in Table 2A.

Exemplary Construct Design

To provide an example, to construct the gRNAs targeting the FWA locus, the binary vector pJRH0646 that contains a plant codon-optimized dCAS9 (pdCAS9) driven by the 35S promoter and fused to a 3×Flag tag at the C-terminus will be used. To construct the dCAS9-epigenetic regulator fusion, a pENTR_D (Invitrogen) plasmid that contains a cDNA fragment of epigenetic regulator (pENTR_epigenetic regulator) will be used to amplify the epigenetic regulator cDNA, which will be cloned into the pJRH0646 plasmid using appropriate restriction enzymes, immediately after the 3×Flag tag (pJRH0646_35S_pdCAS9_3×Flag_epigenetic regulator). This creates a fusion with pdCAS9 at the N terminus of epigenetic regulator and uses a method similar to the method described in (Gilbert et al., 2013). Features of pJRH0646_35S_pdCAS9_3×Flag_epigenetic regulator include a 35S promoter (SEQ ID NO: 394), NLS_pdCas9_NLS (SEQ ID NO: 395), flexible linker (SEQ ID NO: 396), 3×FLAG Tag (SEQ ID NO: 397), U6 promoter driving expression of gRNA (SEQ ID NO: 398), gRNA-FWA sequence (SEQ ID NO: 399), and the gRNA backbone including the tracrRNA and the gRNA terminator (SEQ ID NO: 400).

All the different modules will be amplified by PCR using specific oligos and cloned into a binary plasmid using InFusion (Clontech)

In order to change the target sequence present in the different gRNAs, the protocol described in Li et al., 2013 will be followed using the plasmid gRNA-m6UC. As an example, to generate the gRNAFWA-8 that targets the sequence "gggtttttgcttttcgccat" in the FWA promoter, two consecutive PCRs using the plasmid pUC-gRNA as a template and the oligos 12063(GGAAGCTTAGGCCTT AGAAATCTCAAAATTCCGGC (SEQ ID NO: 870)), 12228 (atggcgaaaagcaaaaacccAATCACTACTTCGTCTCT

TABLE 2A

Exemplary Parameters for Fusion Construct Modules

| Module | Variants | Template DNA |
|---|---|---|
| 1 | pUBI10, pTPL, p35S, endogenous | genomic DNA |
| 2 | dCas9-1xHA-7N-NLS | m6UC |
| 3 | Flexible (SGGGSGGGGSGGGGS (SEQ ID NO: 865), GSSGSNGPGGSGGGGSGG (SEQ ID NO: 866), SSGPPPGTG (SEQ ID NO: 867)).<br>Rigid (AEAAAKEAAAKA (SEQ ID NO: 868)).<br>XTEN (SGSETPGTSESATPES (SEQ ID NO: 869))<br>3xFlag | synthetic oligo |
| 4 | Epigenetic regulator such as e.g. SUVH2, SUVH9, DMS3, MORC6, SUVR2, DRD1, RDM1, DRM3, DRM2, FRG1, FRG2, SHH1, SHH2, AGO4, HDA6, NRPD1, JMJ14, RDR2, NRPE1, NRPD2A/NRPE2, NRPB3/NRPD3/NRPE3A, NRPE3B, NRPB11/NRPD11/NRPE11, NRPB10/NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, SssI_Mtase, NtDRM2_Mtase, ATRX, MOM1, MORC1, DNMT3A, DNMT3L. | cDNA |
| 5 | NOS terminator | m6UC |
| 6 | TBS Insulator | m6UC |
| 7 | gRNAs with different target sequences | gRNA |

(SEQ ID NO: 871)) for PCR1 and 12229 (gggtttttgcttttcgc-catGTTTTAGAGCTAGAAATAGC (SEQ ID NO: 872)), 12064 (GGCAACGCGTTCTAGTAATGC-CAACTTTGTACA (SEQ ID NO: 873)) for PCR2 will be performed.

Alternatively, a tRNA-gRNA expression cassette (Xie, X et al, 2015, Proc Natl Acad Sci USA. 2015 Mar. 17; 112(11):3570-5) will be used to deliver multiple gRNAs simultaneously with high expression level. Due to the repetitive nature of these modules, gene synthesis, instead or traditional cloning, will be used to generate the cassettes.

To target the FWA locus, various alternative gRNA sequences described will be tested, as presented in Table 2B.

TABLE 2B gRNA Molecules Targeting the FWA Promoter

| gRNA Name | crRNA Sequence (5' → 3') |
|---|---|
| gRNA3 | ATTCTCGACGGAAAGATGTA (SEQ ID NO: 874) |
| gRNA4 | ACGGAAAGATGTATGGGCTT (SEQ ID NO: 875) |
| gRNA14 | CCATTGGTCCAAGTGCTATT (SEQ ID NO: 876) |
| gRNA16 | GCGGCGCAAGATCTGATATT (SEQ ID NO: 877) |
| gRNA17 | AAAACTAGGCCATCCATGGA (SEQ ID NO: 878) |

Various other loci in the genome will also be targeted to demonstrate the ability of the fusion protein to target a locus of interest. Exemplary loci that will be targeted include GA1, FLC, and RITA. A series of different gRNA molecules will be designed that target these loci. The crRNA portion of these gRNAs are presented below in Table 2C. The gRNA is a fusion of the crRNA and tracrRNA.

TABLE 2C gRNA Molecules Targeting GA1, FLC, or RITA

| Locus | gRNA Name | crRNA Sequence (5' → 3') |
|---|---|---|
| GA1 | gRNAGA13 | GACACACACATACACATACG (SEQ ID NO: 879) |
| | gRNAGA14 | GCCCTTCAATTCCGTAGCTT (SEQ ID NO: 880) |
| | gRNAGA15 | GGTGGGATCTTCCAAAGCTA (SEQ ID NO: 881) |
| | gRNAGA16 | GGAGAGAAGGATATGATGCA (SEQ ID NO: 882) |
| | gRNAGA17 | GACAATCTCTGATGTGAAGT (SEQ ID NO: 883) |
| FLC | gRNAFLC1 | GTACTATGTAGGCACGACTT (SEQ ID NO: 884) |
| | gRNAFLC2 | GTCAATCCGTATCGTAGGGG (SEQ ID NO: 885) |
| | gRNAFLC3 | GAGCAAAGACGCTCGTCATG (SEQ ID NO: 886) |

TABLE 2C-continued gRNA Molecules Targeting GA1, FLC, or RITA

| Locus | gRNA Name | crRNA Sequence (5' → 3') |
|---|---|---|
| | gRNAFLC4 | GGCTCGTCATGCGGTACACG (SEQ ID NO: 887) |
| | 8RNAFLC5 | GCGACTTGAACCCAAACCTG (SEQ ID NO: 888) |
| RITA | gRNARITA1 | GTTCTCGATGTAGTCAGTGG (SEQ ID NO: 889) |
| | gRNARITA2 | GGGTGGAGCCTCCCTGGAGA (SEQ ID NO: 890) |
| | gRNARITA3 | GATCAGCTCTGAAGCGGTGA (SEQ ID NO: 891) |
| | gRNARITA4 | GATGGTGTCTCCTCTCTGAA (SEQ ID NO: 892) |

Transformation of fwa-4 Plants

*Agrobacterium* AGL0 cells will be transformed with the final binary vector containing the fusion proteins and the gRNA. *Arabidopsis* fwa-4 plants will be transformed using floral dip methods well-known in the art.

Flowering Time Measurements

Progeny of transformed plants (T1s) will be planted and screened for glufosinate-resistant plants that incorporate the T-DNA into the *Arabidopsis* genome, which confers resistance to glufosinate. Among the glufosinate-resistant transgenic plants, flowering time will be measured and compared to early-flowering wild-type Col0 and late-flowering fwa-4 plants. Flowering time will be measured by counting the total number of leaves (rossette and cauline) of each individual plant.

Data Analysis

Plants transformed with the fusion constructs described above will be evaluated for phenotypic differences as compared to corresponding control plants (e.g. wild-type plants) which are suggestive of successful fusion protein targeting to the locus of interest and subsequent silencing at the locus. The phenotype evaluated may vary depending on the locus targeted. Other analyses to be performed may include measuring the expression level of the targeted locus in the transformed plants, measuring the degree of DNA methylation at the targeted locus in the transformed plants, or other assays well-known to those of skill in the art.

It is thought that the fusion proteins containing an epigenetic regulator as described herein and a dCAS9 protein will be able to successfully target a locus of interest and induce epigenetic silencing.

Example 3: Modified CRISPR-Targeting of Epigenetic Regulators to Specific Loci Using MS2 Coat Proteins This Example describes exemplary experimental guidelines for constructing recombinant constructs for use in a modified CRISPR-targeting scheme involving epigenetic regulators as disclosed herein, dCAS9 proteins, and MS2 coat proteins. These constructs may be used to target an epigenetic regulator to a specific locus of a genome using the CRISPR-CAS9 system.

Example 2 describes the recombinant fusing of epigenetic regulator proteins to a dCAS9 protein to target these epigenetic regulators to the e.g. FWA locus. However, it is possible that in some instances, the fusion between the epigenetic regulator and the dCAS9 protein may impact the function of the epigenetic regulator, the dCAS9 protein, or both the epigenetic regulator and the dCAS9 protein. One way to circumvent this potential issue is to use other methods of CRISPR-targeting the epigenetic regulator to the locus of interest other than by fusing the epigenetic regulator to the dCAS9 protein.

One such method involves adding a small RNA sequence that binds to a specific protein which can then be fused to the epigenetic regulator. Recently, work by Konermann et al. 2014 showed that two loops in the gRNA backbone (tetraloop and stem 2) can be modified without negative effects on gRNA-CAS9 activity. They added to these loops a hairpin aptamer that selectively binds dimerized MS2 bacteriophage coat proteins and showed that MS2-mediated recruitment of the transcriptional activator VP64 to the gRNA-CAS9 complex was able to induce expression of a target gene.

Figure 9:
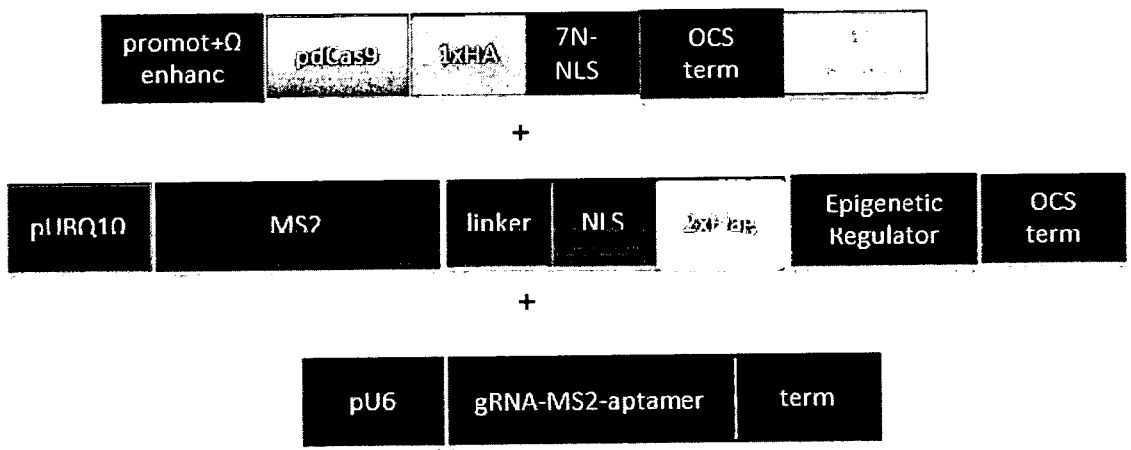
FIG. 9 illustrates the structure of exemplary fusion constructs used in a modified CRISPR-targeting scheme involving the use of MS2 proteins.

A similar technique will be used herein to bypass the possible negative effect that an epigenetic regulator or the CAS9 protein may have on each other's activity when expressed as a fusion protein. A fusion protein between MS2 and an epigenetic regulator will be constructed. The diagram presented in FIG. 9 is a representative scheme of this three component system: (CAS9/gRNA-MS2-aptamer/MS2-epigenetic regulator). Exemplary epigenetic regulators that may be used in this scheme include e.g. SHH1, SHH2, AGO4, HDA6, NRPD1, JMJ14, RDR2, NRPE1, NRPD2A/NRPE2, NRPB3/NRPD3/NRPE3A, NRPE3B, NRPB11/NRPD11/NRPE11, NRPB10/NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, ATRX, MOM1, MORC1, DNMT3A, DNMT3L, DMS3, DRD1, RDM1, DRM3, DRM2, FRG, SUVR2, MORC6, SHH1, SssI MTase, NtDRM2 MTase, SUVH2, and/or SUVH9.

A guide RNA designed to the FWA locus will be fused to the MS2 aptamer to guide the MS2-epigenetic regulator fusion protein to FWA via the dCAS9 protein.

Other RNA-binding proteins may also be used in place of MS2, such as PP7 and COM.

By way of example, a detailed summary of an exemplary MS2 fusion construct containing NtDRM2_Mtase is provided, described herein as m4UC_dCas9_MS2_NtDRM2_Mtase_gRNAMS2. For this purpose, m4UC_UBQ10_dCas9 vector will be used. This vector will contain 2 kb of the 5' promoter of *Arabidopsis* UBQ10 gene driving expression of a plant codon-optimized dCas9 that is fused in its C-terminus to 1×HA tag and 7N Nuclear Localization Signals (NLS). A catalytically inactive Cas9, dCas9, will be generated by site directed mutagenesis to change D10A and H840 amino acids. Next, a modified pMDC123 vector (Curtis et al, Plant Phys, 2003) containing 700 bp of the 3' OCS terminator will be used. 2 kb of UBQ10 promoter, the MS2 binding protein sequence containing 3×GGGS flexible linker and one NLS (Konermann et al Nature. 2014) and 2×Flag sequence will be PCR amplified and cloned in this order by Infusion (Clontech) into the unique AscI site upstream of the gateway cassette of the modified pMDC123 to create pMDC123_MS2. The fragment of pMDC123_MS2 containing UBQ10 promoter_MS2_GatewayCassette_OCS terminator will be PCR amplified and inserted by InFusion (Clontech) into the unique PmeI site of m4UC_UBQ10_dCas9 vector to create m4UC_MS2 vector. A pENTR vector (Invitrogen) containing a cDNA of NtDRM2_Mtase will be used to deliver NtDRM2_Mtase into m4UC_MS2 by LR reaction (Invitrogen) to create m4UC_MS2_NtDRM2_Mtase vector. Last, *Arabidopsis* U6 promoter and a gRNA with MS2 loops at tetraloop and stemloop 2 (Konermann et al Nature. 2014) will be PCR amplified and cloned into the unique PmeI site of m4UC_MS2_NtDRM2_Mtase vector by Infusion (Clontech). Different 20nt-long gRNA protospacers against FWA promoter will be cloned into the gRNA_MS2 by PCR. Alternatively, a tRNA-gRNA expression cassette (Xie, X et al, 2015, Proc Natl Acad Sci USA 2015 Mar. 17; 112(11): 3570-5) will be used.

The nucleotide sequence of m4UC_dCas9_MS2_NtDRM2_Mtase_gRNAMS2 is presented as SEQ ID NO: 671. This vector also includes the following features: gRNA (See Table 38), U6 promoter (SEQ ID NO: 415), OCS terminator (SEQ ID NO: 416), UBQ10 promoter (SEQ ID NO: 417), Insulator (SEQ ID NO: 418), and omega enhancer (SEQ ID NO: 419). The polypeptide sequences encoded in this vector include the following: dCas9_HA_7N-NLS (SEQ ID NO: 420), which includes dCas9 (SEQ ID NO: 421), 1×HA (SEQ ID NO: 422), and 7N-NLS (SEQ ID NO: 423); and MS2_3×GGGG-S_NLS_2×Flag_NtDRM2_MTase (SEQ ID NO: 424), which includes MS2 (SEQ ID NO: 425), 3×GGGGS (SEQ ID NO: 426), NLS (SEQ ID NO: 427), 2×FLAG (SEQ ID NO: 428), and NtDRM2_Mtase (SEQ ID NO: 631).

*Arabidopsis* fwa-4 plants will be transformed with these constructs and evaluated for flowering time phenotypes as described in Examples 1 and 2.

It is thought that the targeting scheme described in this Example will allow the epigenetic regulator to be targeted a locus of interest and induce epigenetic silencing. Early flowering of fwa-4 plants expressing these constructs relative to Col-0 wild-type plants will serve as a proxy of silencing of the FWA locus. Molecular analysis of the plants will also be done to analyze methylation status of the target.

Example 4: Modified CRISPR-Targeting of Epigenetic Regulators to Specific Loci Using SunTag Constructs This Example describes exemplary experimental guidelines for constructing recombinant constructs for use in a modified CRISPR-targeting scheme involving epigenetic regulators as disclosed herein, dCAS9 proteins, and SunTag constructs. These constructs may be used to target an epigenetic regulator to a specific locus of a genome using the CRISPR-CAS9 system.

Example 2 describes the recombinant fusing of epigenetic regulator proteins to a dCAS9 protein to target these epigenetic regulators to the FWA locus. However, it is possible that in some instances, the fusion between the epigenetic regulator and the dCAS9 protein may impact the function of the epigenetic regulator, the dCAS9 protein, or both the epigenetic regulator and the dCAS9 protein. Further, previous work with CRISPR targeting has demonstrated that fusing a protein of interest to a CAS9 protein results in variable abilities to target transcriptional regulation of a locus of interest. Normally, a single copy of a protein has been fused to either the N- or C-terminal portion of CAS9. One way to circumvent these potential issues is to use other methods of CRISPR-targeting the epigenetic regulator to the locus of interest other than by fusing the epigenetic regulator to the dCAS9 protein.

Recently, a technique called SunTag was developed to recruit many effector proteins simultaneously to a location via one dCAS9 protein. In this way, there is an amplification of the effect of targeting, and improved magnitude of gene regulation (Tanenbaum et al, 2014). Tanenbaum et al. described that a dCas9 protein was fused to an unstructured peptide that contains up to 24 copies of the GCN4 epitope. A single chain antibody, scFV, designed to bind this peptide sequence with high affinity and specificity, was fused to an effector protein for gene regulation. Co-expression of the two components allows binding of up to 24 copies of the antibody-fused effector protein to each CAS9-GCN4 fusion protein. In the case of VP64 as an effector protein, this procedure resulted in very high activation of gene expression compared to simple CAS9-VP64 fusion proteins.

Figure 10:
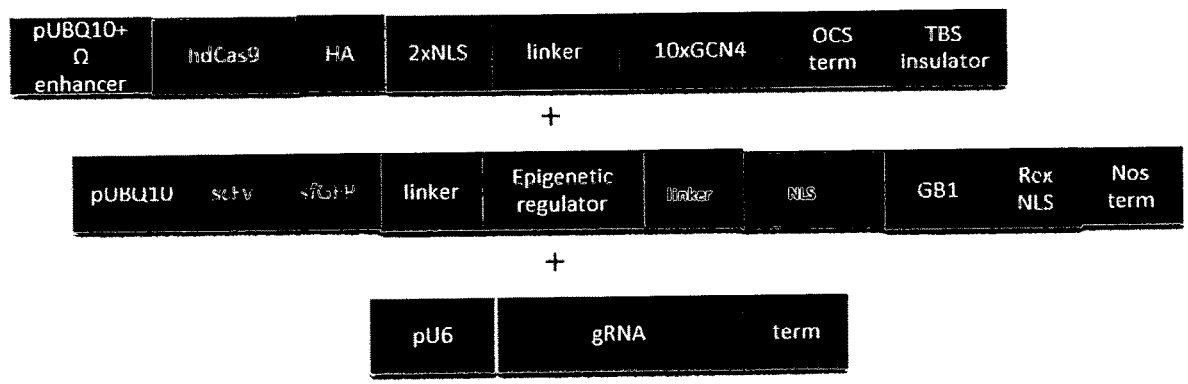
FIG. 10 illustrates the structure of exemplary fusion constructs used in a modified CRISPR-targeting scheme involving the use of SunTag constructs.

A similar technique will be used herein to allow e.g. 10-24 copies of an epigenetic regulator to bind a dCAS9-GCN4 fusion protein. The targeting scheme described in this Example will use a dCAS9-GCN4 fusion similar to that described by Tanenbaum above, but will also involve expressing a fusion of an epigenetic regulator to the scFV antibody. The diagram presented in FIG. 10 is a representative scheme of this targeting system. Exemplary epigenetic regulators that may be used in this scheme include e.g. SHH1, SHH2, AGO4, HDA6, NRPD1, JMJ14, RDR2, NRPE1, NRPD2A/NRPE2, NRPB3/NRPD3/NRPE3A, NRPE3B, NRPB11/NRPD11/NRPE11, NRPB10/NRPD10/NRPE10, NRPB12/NRPD12/NRPE12, NRPB6A/NRPD6A/NRPE6A, NRPB6B/NRPD6B/NRPE6B, NRPB8A/NRPE8A, NRPB8B/NRPD8B/NRPE8B, NRPE5, NRPD4/NRPE4, NRPE7, NRPD7, NRPB5/NRPD5, NRPB9A/NRPD9A/NRPE9A, NRPB9B/NRPD9B/NRPE9B, ATRX, MOM1, MORC1, DNMT3A, DNMT3L, DMS3, DRD1, RDM1, DRM3, DRM2, FRG, SUVR2, MORC6, SHH1, SssI MTase, NtDRM2 MTase, SUVH2, and/or SUVH9. A guide RNA designed to target the FWA locus will be co-expressed with the U6 promoter as in the schemes.

By way of example, a detailed summary of an exemplary SunTag fusion construct containing DMS3 is provided, described herein as m4UC_dCas9_1xHA_2xNLS_GCN4x10_scFv_sfGFP_DMS3_GB1_REXNLS_gRNA. For cloning the SunTag construct (Tanenbaum et al., Cell 2014), the m4UC_UBQ10 vector will be used. This vector contains ~2 kb of the promoter of the *Arabidopsis* UBQ10 gene. The dCas9_1xHA_2xNLS_GCN4x10 fusion will be PCR amplified from one of the original SunTag plasmids from Addgene (pHRdSV40-NLS-dCas9-2xNLS-10xGCN4_V4-NLS-P2A-BFP-NLS-dWPRE, Vale lab). Through the use of two unique restriction sites (HpaI and SmaI), the amplified dCas9 will be inserted into m4UC by In-Fusion cloning (Clontech), such that the UBQ10 promoter drives dCas9 expression, and an OCS terminator follows the sequence. Next, by using a unique PmeI site, a UBQ10 promoter (along with unique restriction sites flanking the promoter) will be inserted into m4UC downstream from a TBS insulator through In-Fusion cloning. Using another one of the SunTag plasmids from Addgene (pHRdSV40-scFv GCN4-sfGFP-VP64-GB1-Rex_NLS-dWPRE), a series of PCRs will replace VP64 with DMS3 flanked by unique restriction sites. The single-chain variable fragment antibody (scFv)+superfolder GFP (sfGFP)+DMS3+GB1+REX NLS PCR amplicon will then be cloned into m4UC downstream from the UBQ10 promoter with In-Fusion cloning using anew unique PmeI site. Through subsequent In-Fusion cloning deletions and additions of PmeI sites, a NOS terminator will be inserted downstream from the REX NLS, followed by a U6 promoter driving the expression of a gRNA. A unique PmeI site at the end also enables the addition of multiple U6 promoter driven gRNAs.

The nucleotide sequence of m4UC_dCas9_1xHA_2xNLS_GCN4x10_scFv_sfGFP_DMS3_GB1_REX NLS_gRNA is presented as SEQ ID NO: 430. This vector also includes the following features: UBQ10 promoter (SEQ ID NO: 431), Omega RBC (SEQ ID NO: 432), OCS terminator (SEQ ID NO: 433), TBS insulator (SEQ ID NO: 434), NOS terminator (SEQ ID NO: 435), U6 promoter+gRNA (SEQ ID NO: 436), and protospacer (SEQ ID NO: 437). The polypeptide sequences encoded in this vector include the following: Cas9 portion (SEQ ID NO: 438), which includes dCas9 (SEQ ID NO: 439), 1xHA (SEQ ID NO: 440), NLS (SEQ ID NO: 441), flexible linker (SEQ ID NO: 442), and GCN4x10 (SEQ ID NO: 443), as well as the antibody portion (SEQ ID NO: 444), which includes scFV (SEQ ID NO: 445), sfGFP (SEQ ID NO: 446), GGGGG linker (SEQ ID NO: 447), DMS3 (SEQ ID NO: 448), GB1 (SEQ ID NO: 449), and REX NLS (SEQ ID NO: 450).

*Arabidopsis* fwa-4 plants will be transformed with these constructs and evaluated for flowering time phenotypes as described in Examples 1 and 2.

It is thought that the targeting scheme described in this Example will allow the epigenetic regulator to be targeted a locus of interest and induce epigenetic silencing. Early flowering of fwa-4 plants expressing these constructs relative to Col-0 wild-type plants will serve as a proxy of silencing of the FWA locus.

Example 5: In Vivo DNA Methylation and Silencing of a Reporter Transgene by Transient Expression in *Nicotiana benthamiana*

This Example demonstrates in vivo DNA methylation and silencing of a reporter transgene by transient expression of a targeting construct in *Nicotiana benthamiana*.

In order to test the ability to methylate target sequences in vivo using the ZF108- or CRISPR/CAS9-targeted NtDRM2 catalytic domain, a transient expression assay in *N. benthamiana* was utilized. Briefly, a reporter construct, where the FWA promoter sequence was cloned upstream of the reporter gene Luciferase (LUC), was expressed in *N. benthamiana* together with a negative control plasmid –GUS-, or with the pMDC_ZF_NtDRM2_Mtase or the pMDC_dCas9_NtDRM2_Mtase plasmids, including the tRNA-gRNA expression cassettes (See Materials and Methods). After 3 days, infiltrated leaves were collected and DNA and RNA were extracted in order to analyze DNA methylation over the FWA promoter and the expression level of the FWA-driven LUC transgene. After bisulfite treatment of the different DNA samples, PCR using specific primers for different FWA promoter regions was performed (BS-PCR).

Materials and Methods

Materials and Methods not otherwise detailed in this section can be found in Example 2 above (e.g. specific gRNA sequences).

Cloning of pMDC_dCas9_1xHA_7N-NLS_NDRM2_Mtase

For this purpose, a modified pMDC123 plasmid (Curtis et al, 2003, Plant Phys) was created first. A fragment containing 1990 bp of the promoter region of *Arabidopsis* UBQ10 gene was cloned, followed by a plant codon-optimized dCas9, containing an omega RBC translational enhancer at the N-terminus of dCas9 and 1xHA tag followed by a nuclear localization signal (NLS) at the C-terminus of dCas9, creating pMDC_dCas9_1xHA_7N-NLS_Gateway.

A cDNA sequence of *Nicotiana tabacum* DRM2 methyltransferase domain (NtDRM2_Mtase) was cloned first into pENTR/D plasmid (Invitrogen) and then delivered into pMDC_dCas9_1×HA_7N-NLS_Gateway by LR reaction (Invitrogen), creating an in-frame fusion of NtDRM2_Mtase cDNA with the upstream dCas9_1×HA_7N-NLS cassette. Two different tRNA-gRNA expression cassettes, one with two different gRNAs and one with four different gRNAs, were created by gene synthesis (SGI-DNA), and inserted at the HindIII restriction site of pMDC_dCas9_1×HA_7N-NLS_NtDRM2_Mtase, upstream of the UBQ10 promoter sequence.

The nucleotide sequences of relevant features of pMDC_dCas9_1×HA_7N-NLS_NtDRM2_Mtase (SEQ ID NO: 634), are set forth, including the UBQ10 promoter (SEQ ID NO: 625), OMEGA enhancer (SEQ ID NO: 626), dCas9 (SEQ ID NO: 627), 1×HA (SEQ ID NO: 628), 7N-NLS (SEQ ID NO: 629), linker (SEQ ID NO: 630), NtDRM2_Mtase cDNA (SEQ ID NO: 631), Terminator (SEQ ID NO: 632). The construct containing pMDC_dCas9_1×HA_7N-NLS_NtDRM2_Mtase also contained the respective tRNA_gRNA (U6p::tRNA-4-17, SEQ ID NO: 642, or U6p::tRNA-16-14-3-17, SEQ ID NO: 657).

To target the FWA locus, various alternative gRNA sequences were used in the tRNA_gRNA expression constructs, as presented in Table 5A.

TABLE 5A

Sequence of the different gRNAs used in the tRNA-gRNA expression cassette

| gRNA Name | crRNA Sequence (5' → 3') |
| --- | --- |
| gRNA3 | ATTCTCGACGGAAAGATGTA (SEQ ID NO: 893) |
| gRNA4 | ACGGAAAGATGTATGGGCTT (SEQ ID NO: 894) |
| gRNA14 | CCATTGGTCCAAGTGCTATT (SEQ ID NO: 895) |
| gRNA16 | GCGGCGCAAGATCTGATATT (SEQ ID NO: 896) |
| gRNA17 | AAAACTAGGCCATCCATGGA (SEQ ID NO: 897) |

Features of pFWA:LUC

The construction of pFWA:LUC is described above. The nucleotide sequence of pFWA:LUC is set forth as SEQ ID NO: 677.

Transient Expression in *N. benthamiana* by Agroinfiltration

The following protocol was used for the agroinfiltration procedure:

Day 1
Inoculate 5 ml LB containing 10 µL of Rif (50 mg/ml) and 5 µL (50 mg/ml) of Kanamycin using a single *agrobacterium* colony.
Incubate them at 28° C. overnight.

Day 2
Make 25 ml LB media containing MES (10 mM, pH5.6), Acetosyringone (20 µM).
Use 500 µl from 5 ml LB culture grown overnight to inoculate the 25 ml LB.
Incubate them at 28° C. overnight.

Day 3
Spin down the 25 ml cultures: 20 mins, 4000 rpm, 28° C.
Make agroinfiltration buffer (IB) (10 mM MES pH5.6, 10 mM MgCl2, 200 µM Acetosyringone)
Re-suspend the pellet in 5 ml of Infiltration buffer (Agro stock)
Use 100 µL from Agro stock to measure the concentration of the agrobacteria at OD 600. Concentration of Agrobacteria containing different plasmid was set at 0.5.
Incubate for 2 hours at room temperature.
Infiltrate 7-8 leaves of 4 week old *N. benthamiana*. At least 3-4 leaves are collected and pooled for each time point.

Results

Figure 11:
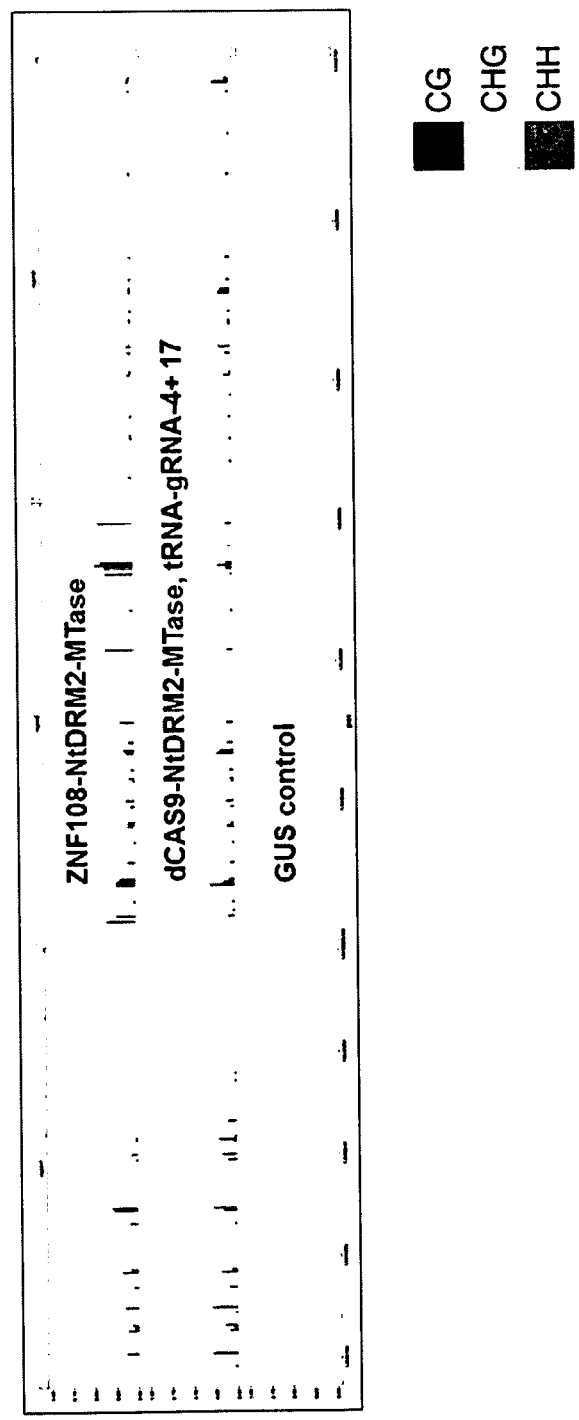
FIG. 11 illustrates BS-PCR of the FWA promoter in agroinfiltrated leaves carrying the specified constructs 3 days post infiltration (dpi).
Figure 13:
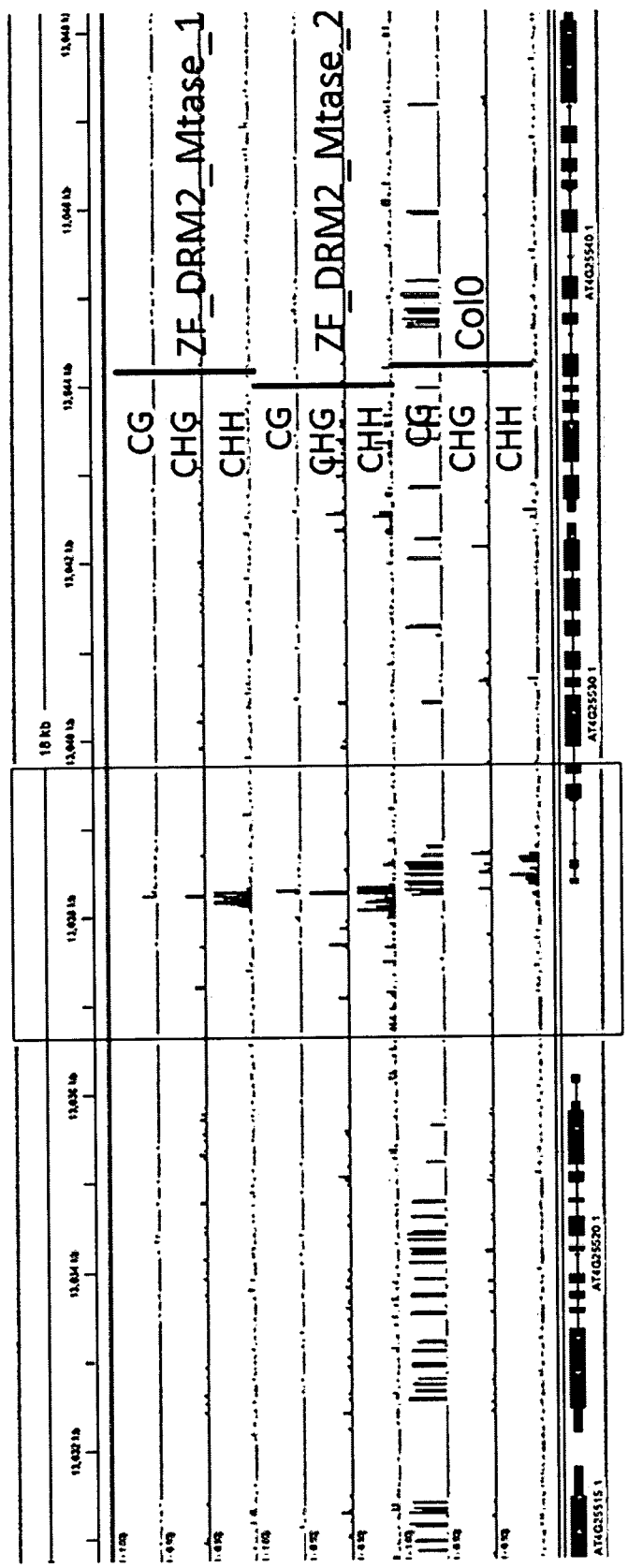
FIG. 13 illustrates methylation profiles of a wild-type Col-0 plant compared to two fwa-4 plants that have been transformed with ZN-DRM2-MTase constructs. The promoter region of FWA is framed in red.

Agroinfiltrated leaves with the constructs described above were analyzed. Sequencing of the BS-PCR products shows that both ZF_NtDRM2_Mtase and dCas9_NtDRM2_Mtase, driven by gRNA4 and 17, were able to promote DNA methylation of FWA (FIG. 11), whereas the FWA+GUS control was unmethylated. Further, whole genome bisulfite sequencing of two representative ZF-NtDRM2_Mtase T1 plants and a Col0 wild-type control revealed robust methylation of the FWA promoter by ZF-NtDRM2_Mtase (FIG. 13). This demonstrates that NtDRM2_Mtase can cause in vivo de novo DNA methylation when targeted either by artificial Zinc Fingers or CRISPR/Cas9 to a genomic locus.

Figure 12:
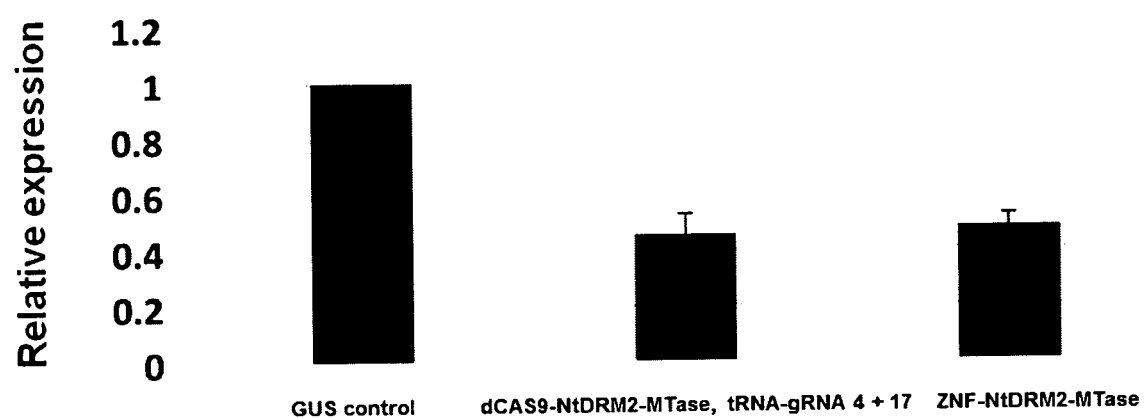
FIG. 12 illustrates relative expression of FWA-driven Luciferase in agroinfiltrated leaves carrying the specified constructs 3 days post infiltration, measured by real-time qPCR. Error bars=Standard error.

In addition, reduced expression levels of the FWA promoter-driven luciferase transgene (LUC), in samples co-infiltrated with ZF_NtDRM2_Mtase and dCas9_NtDRM2_Mtase, (gRNA4 and 17), indicates that targeted hypermethylation of the FWA promoter is correlated with gene silencing (FIG. 12).

Example 6: CRISPR-Targeting of NtDRM2_Mtase to the FWA Locus in *Arabidopsis*

This Example describes exemplary experimental guidelines for constructing recombinant constructs for use in a modified CRISPR-targeting scheme using a plant codon-optimized CAS9 protein that carries two point mutations within the endonuclease domain that is recombinantly fused to a NtDRM2_Mtase protein (pdCAS9-Mtase), and a tRNA-gRNA expression cassette composed of two or four different gRNAs targeting the FWA locus in *Arabidopsis*. fwa-4 mutant plants harboring pdCAS9-Mtase and guide RNA targeting the FWA locus are expected to experience early flowering relative to the control fwa-4 line, and methylation of the FWA sequence.

Materials and Methods

The DNA constructs used in this experiment will be exactly as described in Example 5.

Transformation of fwa-4 Plants

*Agrobacterium* AGL0 cells will be transformed with the plasmids described above and *Arabidopsis* fwa-4 plants will be transformed with this *Agrobacterium* strain using the floral dip method which is well known in the art.

Flowering Time Measurements

Progeny of transformed plants (T1s) will be planted and screened for glufosinate-resistant plants that incorporate the T-DNA into the *Arabidopsis* genome, which confers resistance to glufosinate. Among the glufosinate-resistant transgenic plants, flowering time will be measured and compared to early-flowering wild-type Col-0 and late-flowering fwa-4 plants. Flowering time will be measured by counting the total number of leaves (rosette and cauline) of each individual plant.

FWA Promoter and Expression Analysis

Molecular analysis of the FWA promoter (e.g. methylation status) and FWA expression levels in plants transformed with the constructs described above will be performed as described above.

Example 7: DNA-Binding Domain-Targeting of ATRX, MOM1, and MORC1 to the FWA Locus This Example demonstrates the targeting of ATRX, MOM1, and MORC1 polypeptides to the FWA locus via zinc finger targeting.

Materials and Methods

Recombineering of ATRX-3×FLAG-ZNF108

The sequence of 3×FLAG-ZNF108 was inserted at the 3' end of the ATRX genomic sequence in a transformation-competent artificial chromosome clone using a bacterial recombineering approach (Crawford et al., Science 347 (6222):655-9). This approach results in a cassette in which ATRX is driven by its own endogenous promoter. The accession number of ATRX is AT1G08600.

Figure 14A:
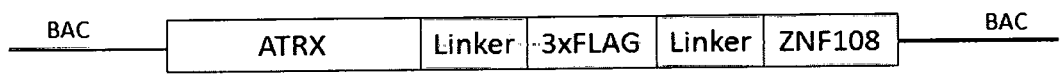
FIG. 14A illustrates a schematic of the ATRX-ZF expression cassette.

The nucleotide sequence of the ATRX-3×FLAG-ZNF108 expression cassette is presented in SEQ ID NO: 720. Features of this cassette include: 5' UTR (SEQ ID NO: 721), ATRX genomic DNA (SEQ ID NO: 722), linker (SEQ ID NO: 723), 3×FLAG (SEQ ID NO: 724), linker (SEQ ID NO: 725), ZNF108 (SEQ ID NO: 726), 3' UTR (SEQ ID NO: 727). The amino acid sequence of ATRX-3×FLAG-ZNF108 is presented in SEQ ID NO: 728. Features include ATRX (SEQ ID NO: 729), linker (SEQ ID NO: 730), 3×FLAG (SEQ ID NO: 731), linker (SEQ ID NO: 732), and ZNF108 (SEQ ID NO: 733). A schematic of the cassette is presented in FIG. 14A.

Recombineering of MOM1-3×FLAG-ZNF108

The sequence of 3×FLAG-ZNF108 was inserted at the 3' end of the MOM1 genomic sequence in a transformation-competent artificial chromosome clone using a bacterial recombineering approach (Crawford et al., Science 347 (6222):655-9). This approach results in a cassette in which MOM1 is driven by its own endogenous promoter. The accession number of MOM1 is AT1G08060.

Figure 16A:
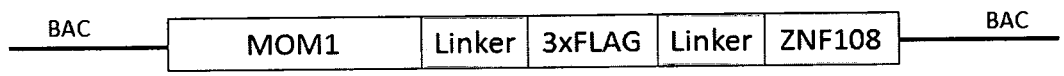
FIG. 16A illustrates a schematic of the MOM1-ZF expression cassette.

The nucleotide sequence of the MOM1-3×FLAG-ZNF108 expression cassette is presented in SEQ ID NO: 734. Features of this cassette include: 5' UTR (SEQ ID NO: 735), MOM1 genomic DNA (SEQ ID NO: 736), linker (SEQ ID NO: 737), 3×FLAG (SEQ ID NO: 738), linker (SEQ ID NO: 739), ZNF108 (SEQ ID NO: 740), 3' UTR (SEQ ID NO: 741). The amino acid sequence of MOM1-3×FLAG-ZNF108 is presented in SEQ ID NO: 742. Features include MOM1 (SEQ ID NO: 743), linker (SEQ ID NO: 744), 3×FLAG (SEQ ID NO: 745), linker (SEQ ID NO: 746), and ZNF108 (SEQ ID NO: 747). A schematic of the cassette is presented in FIG. 16A.

Construction of MORC1 Flag ZF

The 3×Flag-ZF108-BLRP fusion in the pCR2 plasmid was digested with AscI and inserted in the single AscI site of the pENTR-MORC1 plasmid (Moissard et al, 2014), located 6 base pairs after the end of the coding sequence of MORC1 (from *A. thaliana*). The resulting plasmid was recombined into JP726 using LR clonase (Invitrogen) to create pEG302_MORC1_3×Flag_ZF108.

Plant Transformation

All constructs were introduced into fwa-4 plants using *Agrobacterium*-mediated transformation. Transformed lines were selected using BASTA.

Flowering Time Measurements

Flowering time was measured by counting the total number of leaves (rossette and cauline) of each individual plant.

Bisulfite Sequencing and Data Analysis

Bisulfite sequencing followed by PCR amplification and cloning of FWA fragments was done using EZ DNA Methylation-Gold kit (Zymo Research) as performed in Johnson et al. (2008). BS-Seq libraries were generated using the Ovation Ultralow Methyl-seq Library kit from Nugen, and all libraries were sequenced using HiSeq sequencers following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used.

Results

To explore whether ATRX, MOM1, and MORC1 have the ability to trigger de novo DNA methylation at the FWA locus, or otherwise silence this locus, in the fwa-4 mutant, a series of experiments were conducted in an attempt to target these polypeptides to the promoter of the FWA gene in *Arabidopsis*. These polypeptides were fused to the ZF108 zinc finger, which targets the FWA promoter (see Example 1), and transformed into the fwa-4 mutant. ZF-targeting lines were constructed as described above. The flowering time of independent transgenic lines was scored.

MORC1-ZF

The flowering time results for MORC1-ZF are shown below in Table 7A. ~57% of the T1 lines analyzed showed early flowering relative to the fwa-4 mutant. The results suggest that MORC1 was able to be targeted to the FWA locus via ZF-targeting and induce silencing of this locus.

TABLE 7A

| Early flowering in T1 lines compared to fwa-4 | | | |
|---|---|---|---|
| | early | late | % early |
| MORC1-ZF | 26 | 20 | 57 |

ATRX-ZF

Figure 14B:
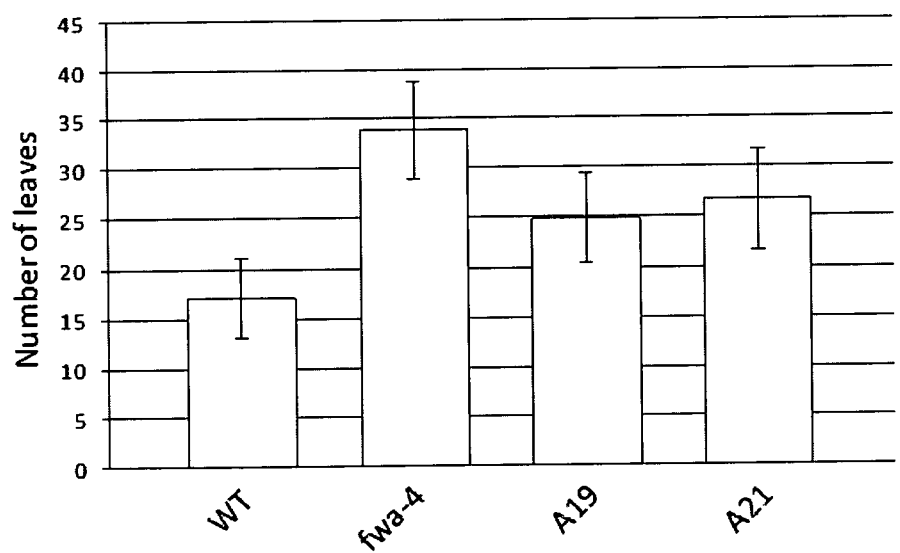
FIG. 14B illustrates flowering time data for wild-type Col-0, fwa mutants, and two independent ATRX-ZF T2 lines (A19 and A21). N=32-50 plants for each plant line presented.

Flowering time was also analyzed in ATRX-ZF lines. As can be seen in FIG. 14B, two independent T2 lines housing ATRX-ZF are shown that exhibited early flowering as compared to the fwa mutant. The results suggest that ATRX was able to be targeted to the FWA locus via ZF-targeting and induce silencing of this locus.

Figure 15:
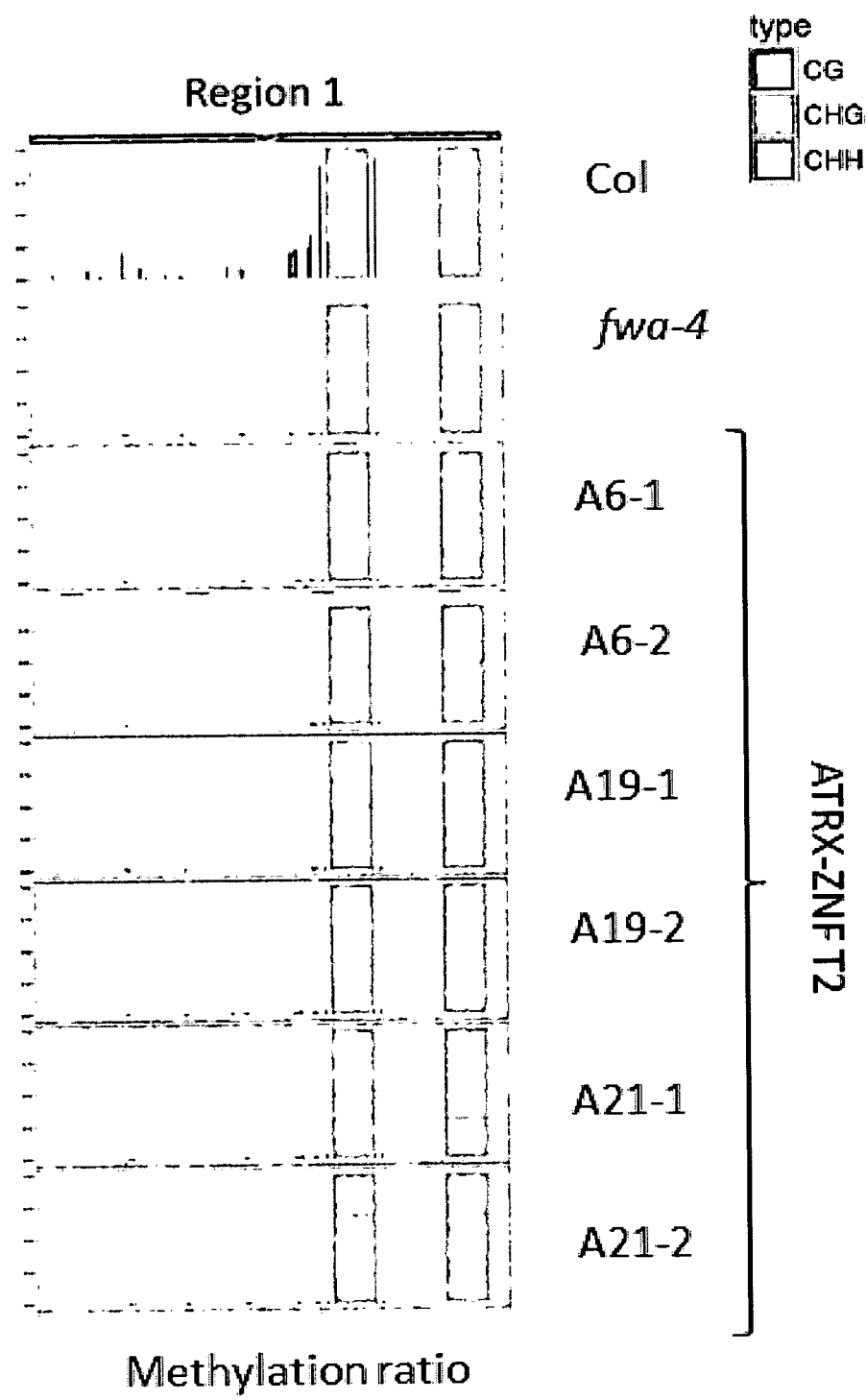
FIG. 15 illustrates methylation profiles at the FWA promoter region for wild-type Col-0, fwa-4 mutant, and two plants each from three independent ATRX-ZF T2 lines (A6, A19, and A21).

In order to analyze whether the early flowering phenotype in the ATRX-ZF lines was due to the methylation of the FWA promoter, a bisulfite sequencing assay was performed in independent ATRX-ZF lines that showed the early flowering phenotype relative to fwa-4. The results, which are presented in FIG. 15, interestingly show that robust DNA methylation was not re-established at FWA in the ATRX-ZF lines. This is interesting because although introduction of ATRX-ZF into the fwa mutant background did not induce robust methylation at the targeted FWA locus in T2 plants, these ATRX-ZF T2 plants nonetheless exhibit early flowering in an otherwise late-flowering fwa mutant background. Regardless of the mechanism, the early flowering phenotypes observed in transgenic fwa-4 plants housing ATRX-ZF is evidence that FWA was silenced, even if that silencing is not a function of re-establishment of DNA methylation at the FWA promoter.

MOM1-ZF

Figure 16B:
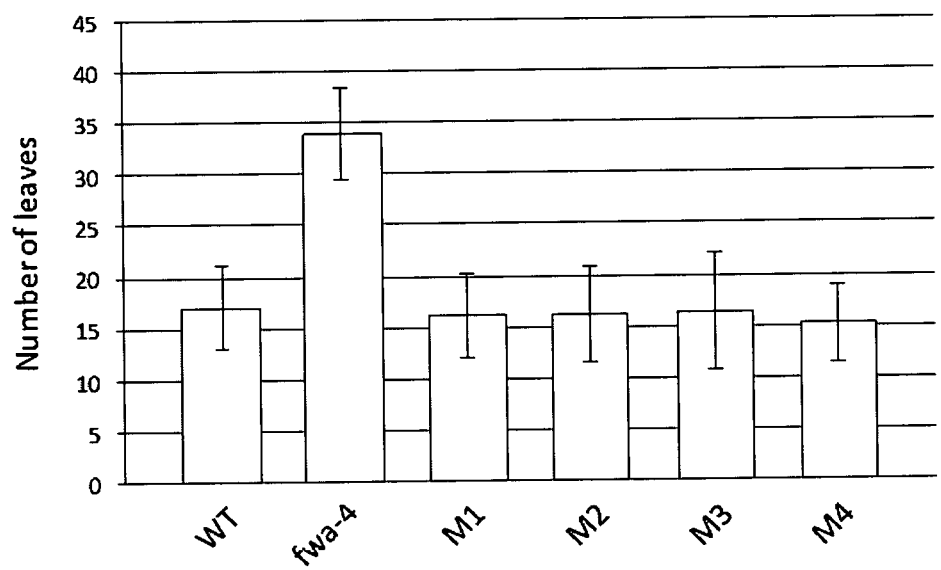
FIG. 16B illustrates flowering time data for wild-type Col-0, fwa-4 mutant, and four independent MOM1-ZF T2 lines (M1, M2, M3, and M4). N=50 plants for each plant line presented.

Flowering time was also analyzed in MOM1-ZF lines. As can be seen in FIG. 16B, four independent T2 lines housing MOM1-ZF showed early flowering as compared to the fwa mutant. The results suggest that MOM1 was able to be targeted to the FWA locus via ZF-targeting and induce silencing of this locus.

Figure 17:
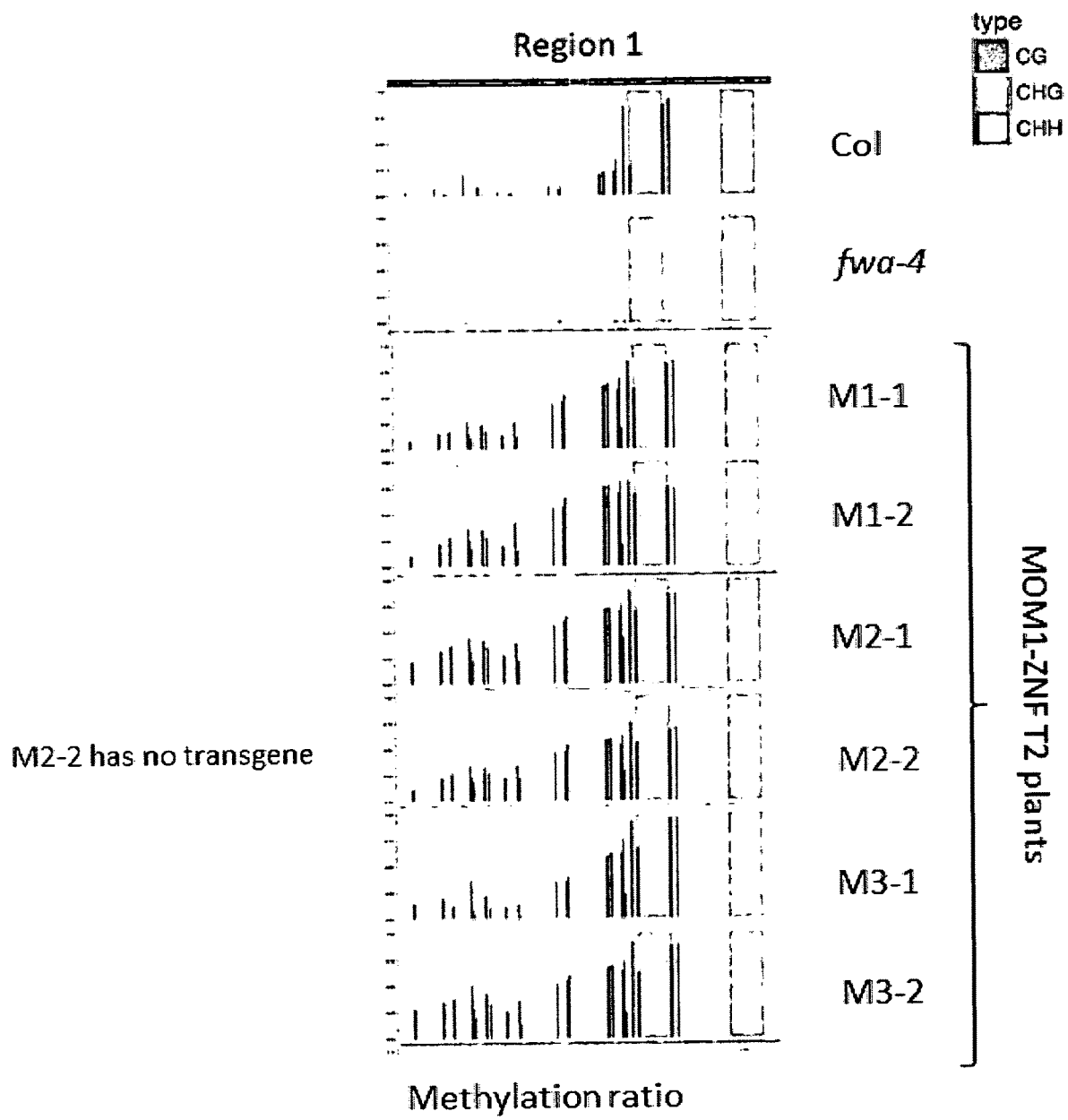
FIG. 17 illustrates methylation profiles at the FWA promoter region for wild-type Col-0, fwa-4 mutant, and two plants each from three independent MOM1-ZF T2 lines (M1, M2, and M3). Line M2-2 is derived from a T1 line housing MOM-ZF, but M2-1 is a T2 plant that does not carry the MOM1-ZF transgene.

In order to analyze whether the early flowering phenotype in the MOM1-ZF lines was due to the methylation of the FWA promoter, a bisulfite sequencing assay was performed in independent MOM1-ZF lines that showed the early flowering phenotype relative to fwa-4. The results, which are presented in FIG. 17, show that robust DNA methylation was re-established at FWA in the MOM1-ZF lines. Thus, MOM1-ZF was effective in targeting methylation at the FWA promoter. Of particular note, MOM1-ZF T2 plant #M2-2 did not contain the MOM1-ZF transgene, yet still exhibited early flowering and methylation at the FWA promoter. This result suggests that MOM1-ZF-mediated methylation is stably inherited in progeny plants even after crossing away the MOM1-ZF transgene.

Example 8: DNA-Binding Domain-Targeting of SssI Methyltransferase to the FWA Locus This Example demonstrates the targeting of SssI methyltransferase protein to specific loci to cause CG-specific DNA methylation.

Materials and Methods

Plasmid Construction

For this purpose, a modified pMDC123 plasmid (Curtis et al, 2003, Plant Phys) was created first, containing 1990 bp of the promoter region of Arabidopis UBQ10 gene upstream of the BLRP_ZF108_3×Flag cassette present in one of the modified pCR2 plasmids described above. Both the UBQ10 promoter and BLRP_ZF108_3×Flag are upstream of the gateway cassette (Invitrogen) present in the original pMDC123 plasmid. A plant codon-optimized cDNA sequence of the Methyltransferase gene from *Spiroplasma* sp. strain MQ1 (M.SssI) was cloned first into pENTR/D plasmid (Invitrogen) and then delivered into the modified pMDC123 by LR reaction (Invitrogen), creating an in-frame fusion of M.SssI cDNA with the upstream BLRP_ZF_3× Flag cassette.

The nucleotide sequence of the pUBQ10::ZF_3× Flag_M.SssI expression cassette is presented in SEQ ID NO: 756. Features of this cassette include: UBQ10 promoter (SEQ ID NO: 757), ZF108 (SEQ ID NO: 758), 3×FLAG (SEQ ID NO: 759), plant codon optimized M.SssI (SEQ ID NO: 760), and OCS term (SEQ ID NO: 761). The amino acid sequence of ZF_3×Flag_SssI is presented in SEQ ID NO: 762. Features include ZF108 (SEQ ID NO: 763), 3×FLAG (SEQ ID NO: 764), and SssI (SEQ ID NO: 765).

Plant Transformation and Flowering Time Measurement

This construct above was introduced into fwa-4 plants using *Agrobacterium*-mediated transformation. Transformed lines were selected using BASTA. Flowering time was scored by counting the number of rossette and caulinar leaves.

Bisulfite Sequencing and Data Analysis

BS-Seq libraries were generated using the Ovation Ultralow Methyl-seq Library kit from Nugen, and all libraries were sequenced using HiSeq sequencers following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used.

Results

Figure 18:
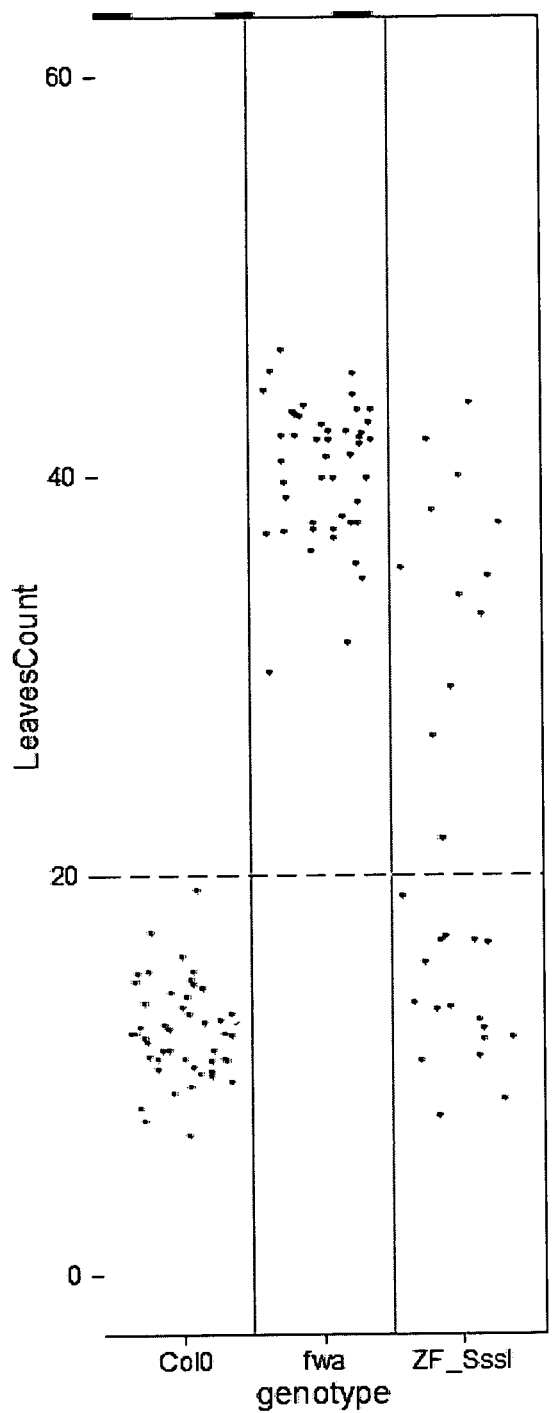
FIG. 18 illustrates flowering time of wild-type Col-0 plants, fwa-4 mutant plants, and fwa-4 T1 plants transformed with ZF_SssI. Plants were grown on soil under long day photoperiods until the plants flowered, at which time flowering time was assessed.

From Example 1, it was found that a ZF-SssI fusion protein in the fwa-4 mutant background was able to induce early flowering of these plants as compared to fwa-4 controls, consistent with silencing of FWA in the ZF-SssI lines. These results are presented in graphical form in FIG. 18.

Figure 19:
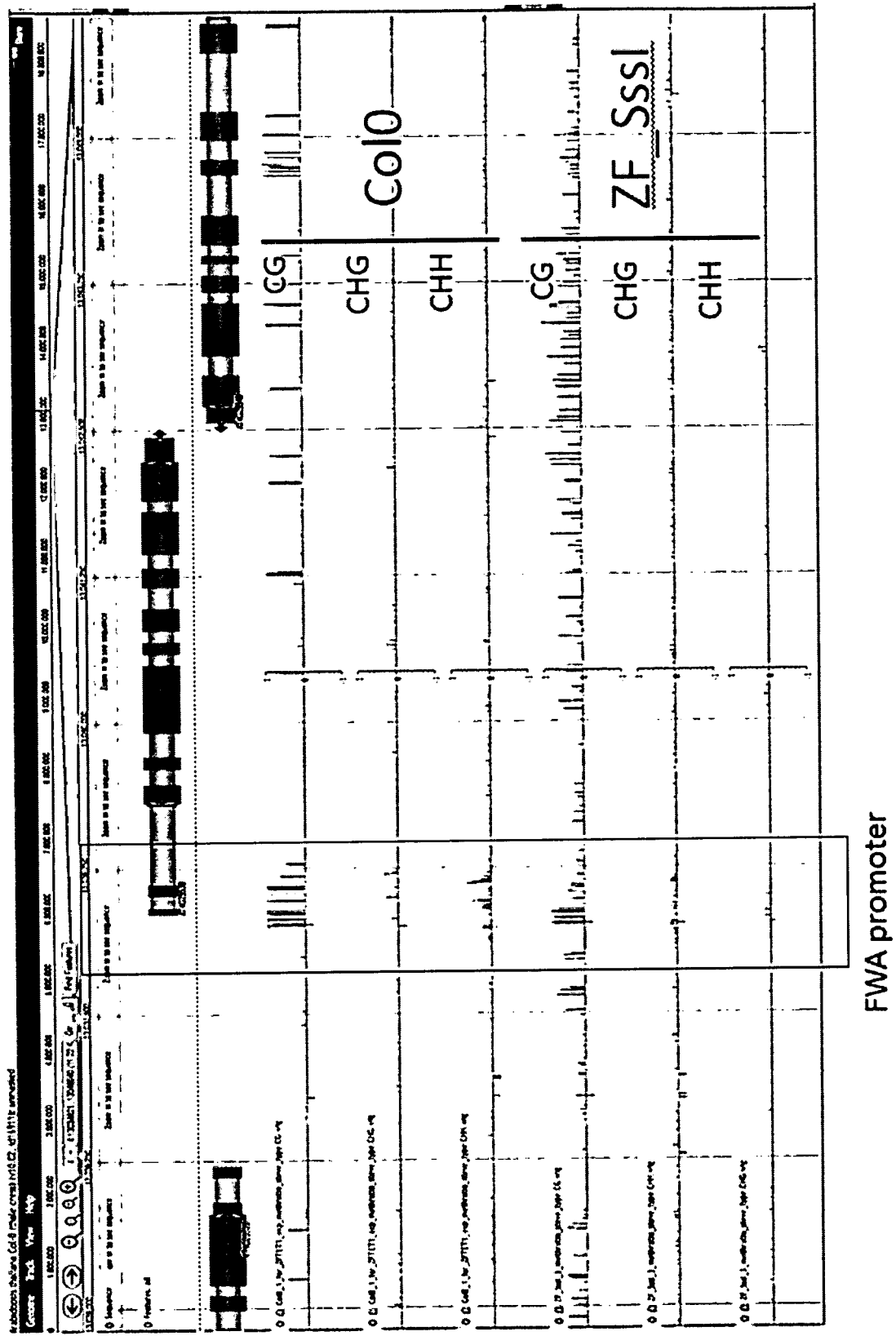
FIG. 19 illustrates whole genome bisulfite sequencing results of T1 ZF_SssI and Col-0 wild-type plants. DNA methylation of two independent transgenic lines that showed an early flowering phenotype was analysed by BS-seq. Methylation at different contexts (CG, CHG and CHH, where H is C, T, or A) is shown for a wild-type Col-0 plant and a representative ZF108-SssI line in which ZF108-SssI was transformed into the unmethylated fwa-4 epimutant. The FWA promoter is marked in red.
Figure 20:
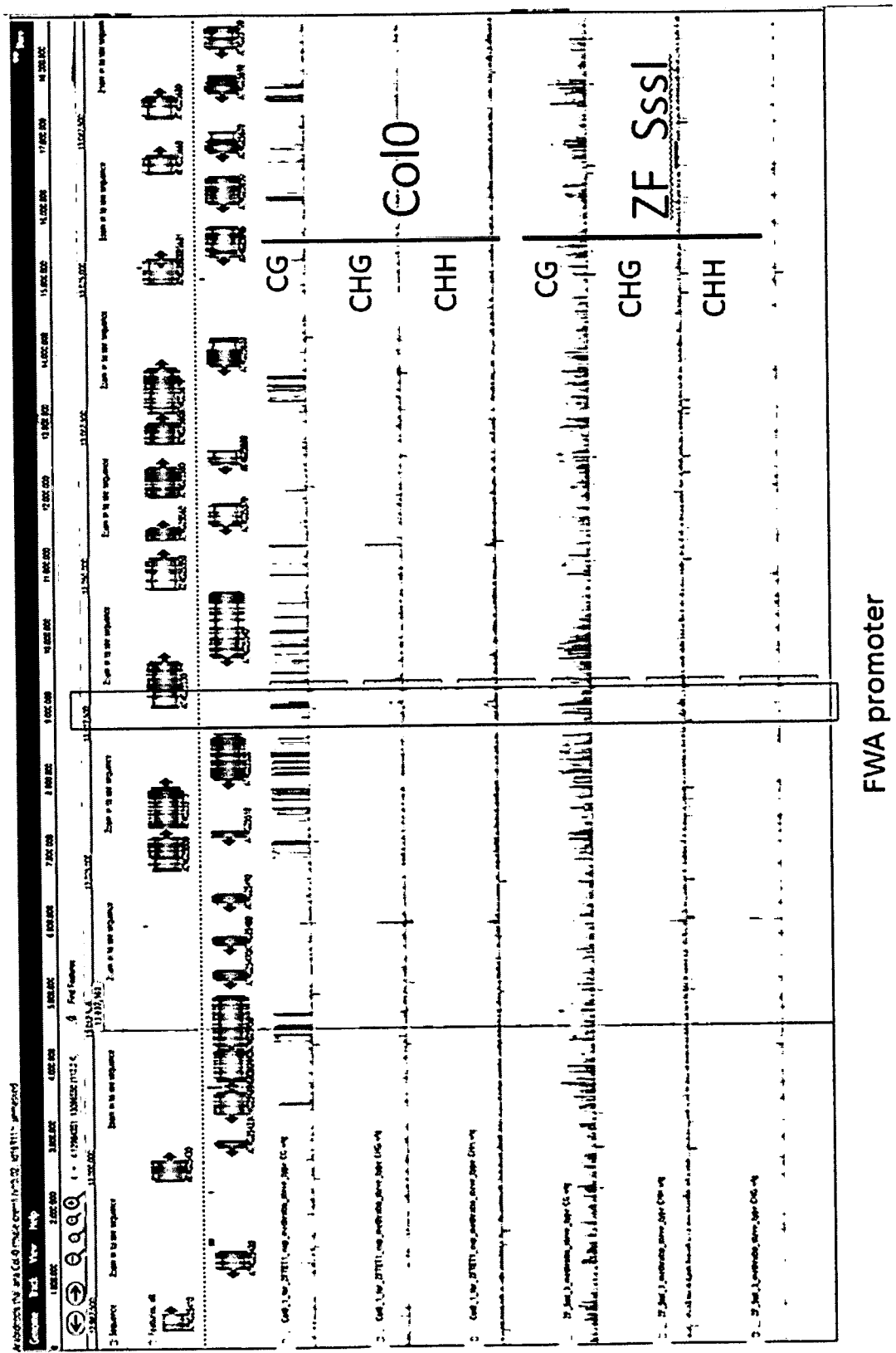
FIG. 20 illustrates a genomic zoom-out of the whole genome bisulfite sequencing results presented in FIG. 19 for T1 ZF_SssI and Col-0 wild-type plants. DNA methylation of two independent transgenic lines that showed an early flowering phenotype was analysed by BS-seq. Methylation at different contexts (CG, CHG and CHH, where H is C, T, or A) is shown for a wild-type Col-0 plant and a representative ZF108-SssI line in which ZF108-SssI was transformed into the unmethylated fwa epimutant. The FWA promoter is marked in red.

To analyze the methylation status of the FWA promoter in the ZF-SssI lines, a whole-genome bisulfite sequencing assay was performed in two independent ZF108-SssI lines that showed the early flowering phenotype. The results, which are presented in FIG. 19 and FIG. 20, demonstrate that the FWA promoter is being methylated in these lines, predominantly in the CG context. Strikingly, CG methylation in these lines extended over a much larger region than just the FWA promoter, and in fact covered the entire genome. It thus appears that ZF-SssI is able to induce genome-wide CG hypermethylation.

Figure 21A:
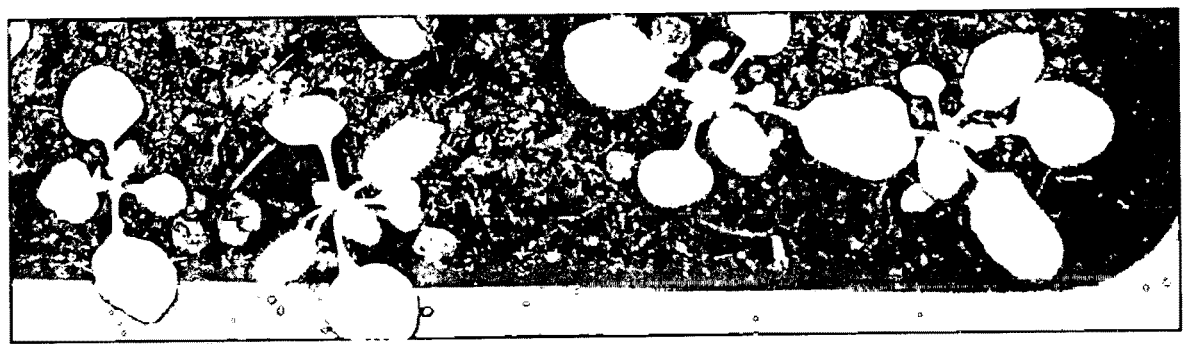
FIG. 21A and FIG. 21B illustrate the phenotypes of ZF108-SssI T2 plants. Plants from some of the ZF108-SssI T2 lines displayed abnormal development and formed chimeras where different sectors of the same leaves displayed chlorosis.
Figure 21B:

As a consequence of the massive accumulation of CG methylation throughout the genome, plants in the T2 generation showed abnormal phenotypes and pigmentation chimeras in the leaves (FIG. 21A and FIG. 21B), probably as a consequence of gene mis-regulation caused by hypermethylation.

Targeting SssI polypeptides to specific loci in a manner that actually induces genome-wide hypermethylation, as described herein, may have applications in crop science. For example, this technology may be used to create novel epigenetic traits, and/or to restore the loss of methylation at specific but unknown genes, for instance those that lose methylation during tissue culturing.

Example 9: Targeting of DRM2-MTase to Specific Loci Using SunTag System

This Example demonstrates the targeting of the catalytic domain of DRM2, using a SunTag system, to specific loci in plants and the subsequent induction of methylation of the targeted loci.

Materials and Methods

Plasmid Construction

The SunTag VP64 constructs as described in Tanenbaum et al, 2014 were ordered from Addgene (pHRdSV40-dCas9-10×GCN4_v4-P2A-BFP and pHRdSV40-scFv-GCN4-sfGFP-VP64-GB1-NLS). These constructs were used as starting materials to construct a SunTag targeting system using DRM2-MTase, with all components of the system present on a single vector. The catalytic methylatransferase domain (residues 255-608) of the *Nicotiana tabacum* DRM2 protein (DRM2-MTase) was used to replace VP64 with a methylation effector.

Plant-specific promoters and transcriptional terminators were used in the new construct, although a human codon-optimized, nuclease-deficient (hdCAS9) was also used. Human codon optimized dCas9 expression, which is fused to one HA tag, two nuclear localization signals, and a linker followed by a 10× epitope tail (10×GCN4), was driven by the plant UBIQUITIN10 (UBQ10) promoter, which is ubiquitously expressed in *Arabidopsis*. The UBQ10 promoter preceding dCas9-10×GCN4 was followed by an Omega translational enhancer sequence. The single chain antibody (scFV) portion of the system, which was also driven by the UBQ10 promoter, was fused to superfolder GFP, followed by a linker, DRM2-MTase, another linker, an NLS that was added for plant nuclear localization, GB1, and a REX NLS. The dCas9-10×GCN4 and scFv-VP64 cassettes were separated by a plant-specific TBS insulator sequence (SEQ ID NO: 766). gRNA expression was controlled by the Pol III specific U6 promoter and termination was controlled by the Pol III termination sequence.

Figure 22:
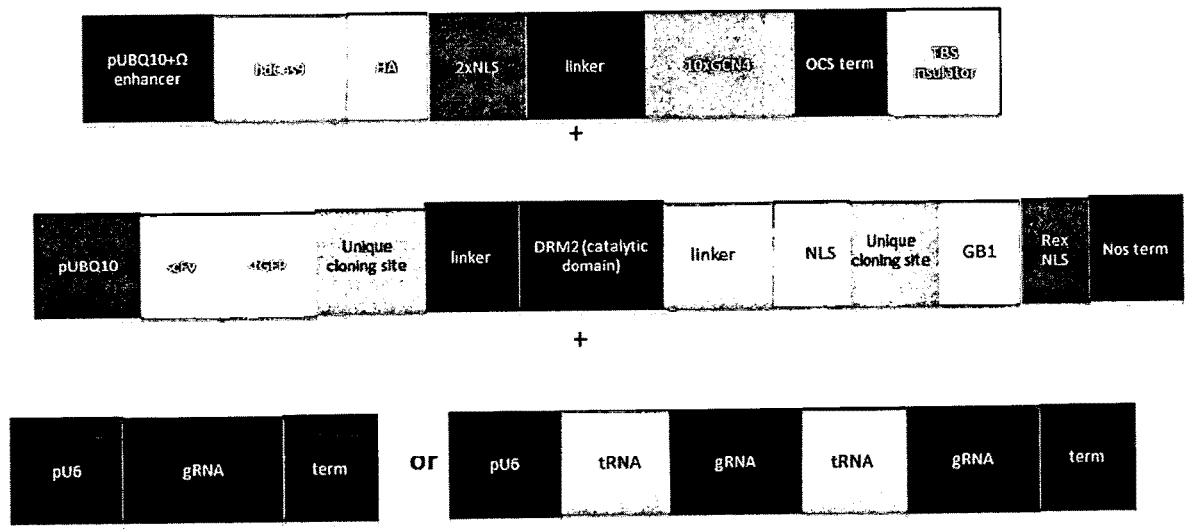
FIG. 22 illustrates a schematic of the expression cassettes present in the vector housing the SunTag DRM2-MTase expression system.

All features of the constructed SunTag DRM2-MTase system were present on a single vector. The dCAS9-10× GCN4 cassette, scFv-DRM2-MTase cassette, and respective gRNA cassette were cloned into a binary vector using In-Fusion cloning. Only one respective gRNA cassette was present in the SunTag vector transformed into plants. A schematic of the expression cassettes for the SunTag DRM2-MTase system is presented in FIG. 22.

Construction of dCAS9-10×GCN4 Cassette

The dCAS9-10×GCN4 portion of the SunTag DRM2-MTase vector that was constructed is contained in expression cassette pUBQ10_Omega RBC_dCas9_1×HA_2× NLS_flexible linker_10×GCN4 (nucleic acid sequence presented in SEQ ID NO: 767). This cassette contains the following features and nucleic acid sequences are provided: UBQ10 promoter (SEQ ID NO: 768), Omega RBC translation enhancer (SEQ ID NO: 769), dCas9 (SEQ ID NO: 770), 1×HA (SEQ ID NO: 771), 2×NLS (SEQ ID NO: 772), flexible linker (SEQ ID NO: 773), 10×GCN4 (SEQ ID NO: 774). The expression cassette further included an OCS terminator (SEQ ID NO: 775).

This expression cassette produces a recombinant dCas9-10×GCN4 fusion protein (SEQ ID NO: 776): dCAS9-1× HA-2×NLS-flexible linker-10×GCN4. The amino acid sequences of features present in the recombinant fusion protein expressed from this expression cassette are: dCAS9 (SEQ ID NO: 777), 1×HA (SEQ ID NO: 778), 2×NLS (SEQ ID NO: 779), flexible linker (SEQ ID NO: 780), and 10×GCN4 (SEQ ID NO: 781).

Construction of scFv-DRM2-MTase Cassette

The scFv-DRM2-MTase portion of the SunTag DRM2-MTase vector that was constructed is contained in expression cassette pUBQ10-scFv-sfGFP-glycine linker-DRM2-MTase-glycine linker-SV40 type NLS-GB1-REX NLS-NOS terminator (nucleic acid sequence presented in SEQ ID NO: 782). This cassette contains the following features and nucleic acid sequences are provided: UBQ10 promoter (SEQ ID NO: 783), scFv single chain antibody (SEQ ID NO: 784), sfGFP (SEQ ID NO: 785), glycine linker (SEQ ID NO: 786), DRM2-MTase (SEQ ID NO: 787), glycine linker (SEQ ID NO: 786), SV40 type NLS (SEQ ID NO: 788), GB1 (SEQ ID NO: 789), REX NLS (SEQ ID NO: 790), and NOS terminator (SEQ ID NO: 791).

This expression cassette produces a recombinant scFv-DRM2-MTase fusion protein (SEQ ID NO: 792): scFv-sfGFP-glycine linker-DRM2-MTase-glycine linker-SV40 type NLS-GB1-REX NLS. The amino acid sequences of features present in the recombinant fusion protein expressed from this expression cassette are: scFv (SEQ ID NO: 793), sfGFP (SEQ ID NO: 794), glycine linker (SEQ ID NO: 795), DRM2-MTase (SEQ ID NO: 796), SV40-type NLS (SEQ ID NO: 797), GB1 (SEQ ID NO: 798), and REX NLS (SEQ ID NO: 799).

Construction of gRNA Cassettes

For targeting the FWA gene promoter, a gRNA expression cassette was constructed. This expression cassette was U6:gRNA4 (nucleic acid sequence presented in SEQ ID NO: 800). This cassette contains the following features and nucleic acid sequences are provided: U6 promoter (SEQ ID NO: 801), protospacer #4 (SEQ ID NO: 802), gRNA backbone (SEQ ID NO: 803), and PolIII terminator (SEQ ID NO: 804).

Design of tRNA:gRNA Cassette for Targeting the FWA Promoter

A tRNA:gRNA expression cassette was designed for targeting the FWA promoter. This cassette for targeting FWA includes two different gRNA molecules and uses protospacer #4 and protospacer #17. The sequence of this cassette is presented in SEQ ID NO: 805.

Construct Transformation into *Arabidopsis*

The vector described above housing the SunTag DRM2-MTase expression system was transformed into *Agrobacterium*. The vector was then introduced into fwa-4 epimutant *Arabidopsis thaliana* plants using *Agrobacterium*-mediated transformation via the floral dip method. T1 transgenic plants were selected based on their resistance to Hygromycin.

Fluorescent Microscopy

Visualization of sfGFP fluorescence was performed using a Zeiss confocal microscope and recommended wavelengths to visualize GFP fluorescence. Leaf sections were taken from transgenic SunTag DRM2-MTase plants and placed on microscope slides for visualization.

Bisulfite Sequencing

BS-Seq libraries were generated as previously reported (Cokus et al., 2008) and all libraries were sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq, up to 2 mismatches were allowed and only uniquely mapped reads were used.

Chromatin Immunoprecipitation (ChIP) and ChIP-Seq

Transgenic SunTag DRM2-MTase seeds were plated on MS media and grown. Tissue was collected and two grams were used to grind the tissue. Nuclear Isolation Buffer, protease inhibitors, and 1% formaldehyde was then added to the powder. This solution was incubated at room temperature on a rotator for 10 minutes. Glycine was then added to stop cross-linking. The solution was filtered, spun down, and the resulting pellet was resuspended with extraction buffer 2+inhibitors. This was spun down, and the resulting pellet was resuspended with extraction buffer 3+inhibitors. This was spun and resuspended with Nuclear Lysis Buffer. The solution was moved to a new tube and diluted with ChIP dilution buffer. Samples were then sonicated (30 seconds on, 30 seconds off at maximum power for 15 minutes). dCas9 and the SunTag system were then immunoprecipitated using an anti-HA antibody. Samples were then washed and eluted. DNA was then extracted using phenol-chloroform and libraries were then made for sequencing by following the procedures recommended by the NuGEN kit used. Sequencing reads were then aligned using bowtie2.

Results

Figure 23:
FIG. 23 illustrates fluorescence microscopy of T2 *A. thaliana* plants (fwa-4) transformed with the iteration of the SunTag DRM2-MTase vector where DRM2-MTase was fused to an SV40-type NLS. Tissue shown is midvein tissue.

In preliminary work, it was found that the scFv-sfGFP fusion protein from the construct described in Tanenbaum et al, 2014 did not localize to the nucleus in plants. This construct from Tanenbaum et al, 2014 was thus re-designed to replace the failed NLS with a linker followed by a modified SV40-type NLS. This is the vector described above in the Materials and Methods. T2 plants housing this SunTag DRM2-MTase vector were similarly evaluated for nuclear localization of the scFv-sfGFP-DRM2-MTase fusion protein. As can be seen in FIG. 23, the SV40-type NLS was able to facilitate nuclear localization of the scFv-sfGFP-DRM2-MTase fusion protein.

Targeting FWA Expression Using gRNA4

Following confirmation that the SunTag DRM2-MTase expression system components were being expressed and localized to the nucleus as described above, various plant lines were evaluated for whether this system could target DRM2-MTase to the FWA promoter and induce methylation. Various T2 lines housing the SunTag DRM2-MTase construct that contains gRNA4 (which targets the FWA promoter) were evaluated for methylation levels at the FWA promoter.

Figure 24:
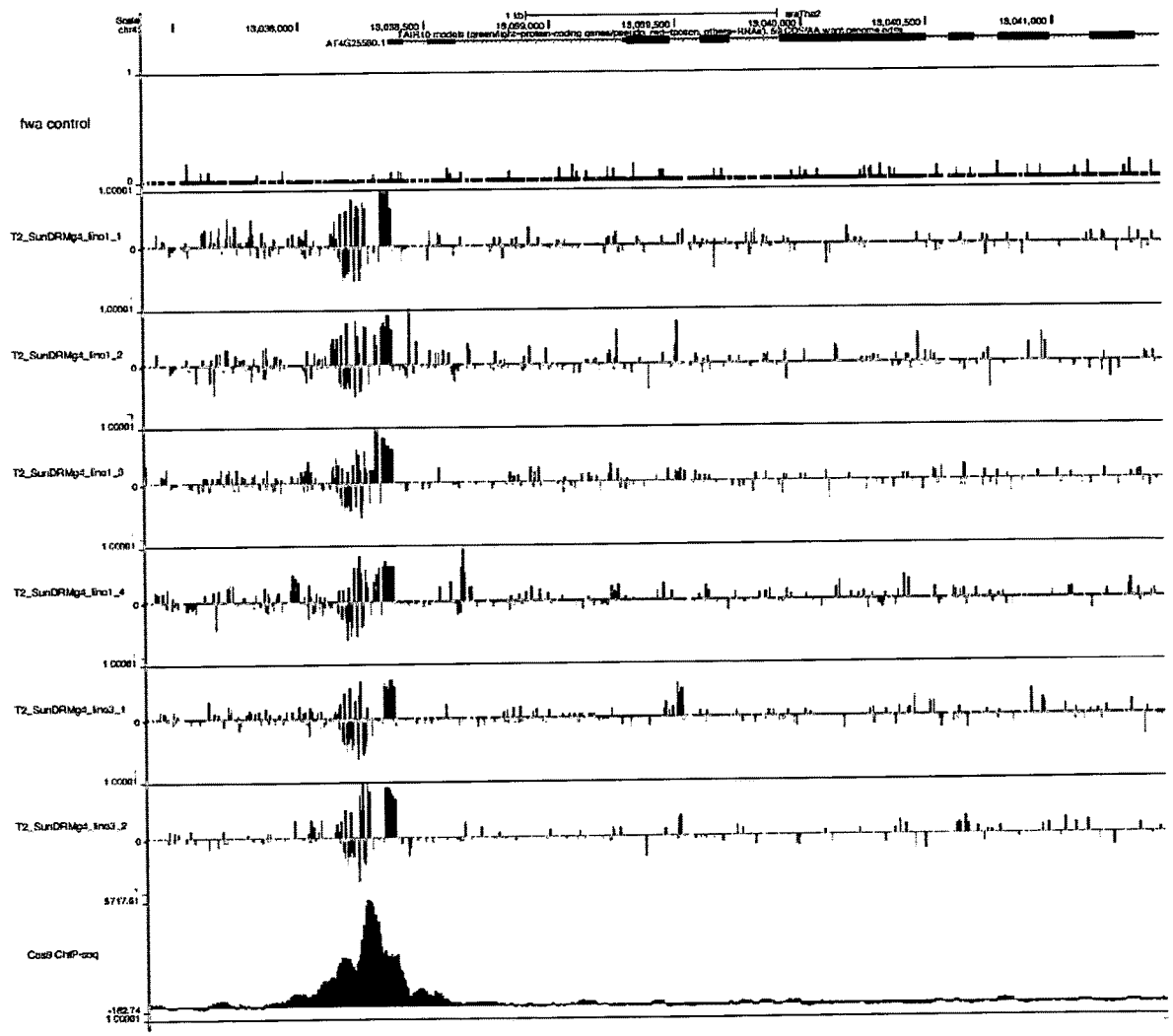
FIG. 24 illustrates SunTag-DRM2-MTase induction of DNA methylation of the FWA promoter. Results are from whole genome bisulfite sequencing from the unmethylated fwa epiallele (top row) and six different T2 plants containing the SunTag-DRM2-MTase system with gRNA4 targeted to FWA. Shown are CHH methylation tracks for four independent plants from transgenic line 1 and two independent plants from transgenic line 3. Bottom row shows signal from chromatin immunoprecipitation sequencing of dCas9 in a T2 SunTag+gRNA4 line. The methylation is highly localized to the region of the FWA promoter targeted by dCas9.

Multiple plants from multiple independent T2 SunTag DRM2-MTase+gRNA4 lines exhibited increased CG, CHG, and CHH methylation at the FWA promoter as compared to fwa-4 controls. FIG. 24 shows examples of the increased CHH methylation. In fwa mutants, an epimutation results in loss of methylation from the FWA promoter, as was observed in FIG. 24. The data indicates that introduction of the SunTag DRM2-MTase+gRNA4 system was able to induce methylation of the FWA promoter in an otherwise fwa-4 epimutant background.

As described above, the results suggest that, in the SunTag DRM2-MTase lines containing a gRNA that targets the FWA promoter, the gRNA is able to successfully guide Cas9 to the FWA locus, and that DRM2-MTase is then able to induce methylation of FWA. To confirm that Cas9 was targeted to the FWA promoter in the SunTag lines, ChIP-seq of Cas9 using an anti-HA antibody (Cas9 is 1×HA tagged) was performed. As can be seen in FIG. 24, ChIP-seq data confirmed Cas9 binding to FWA via gRNA4.

Figure 25:
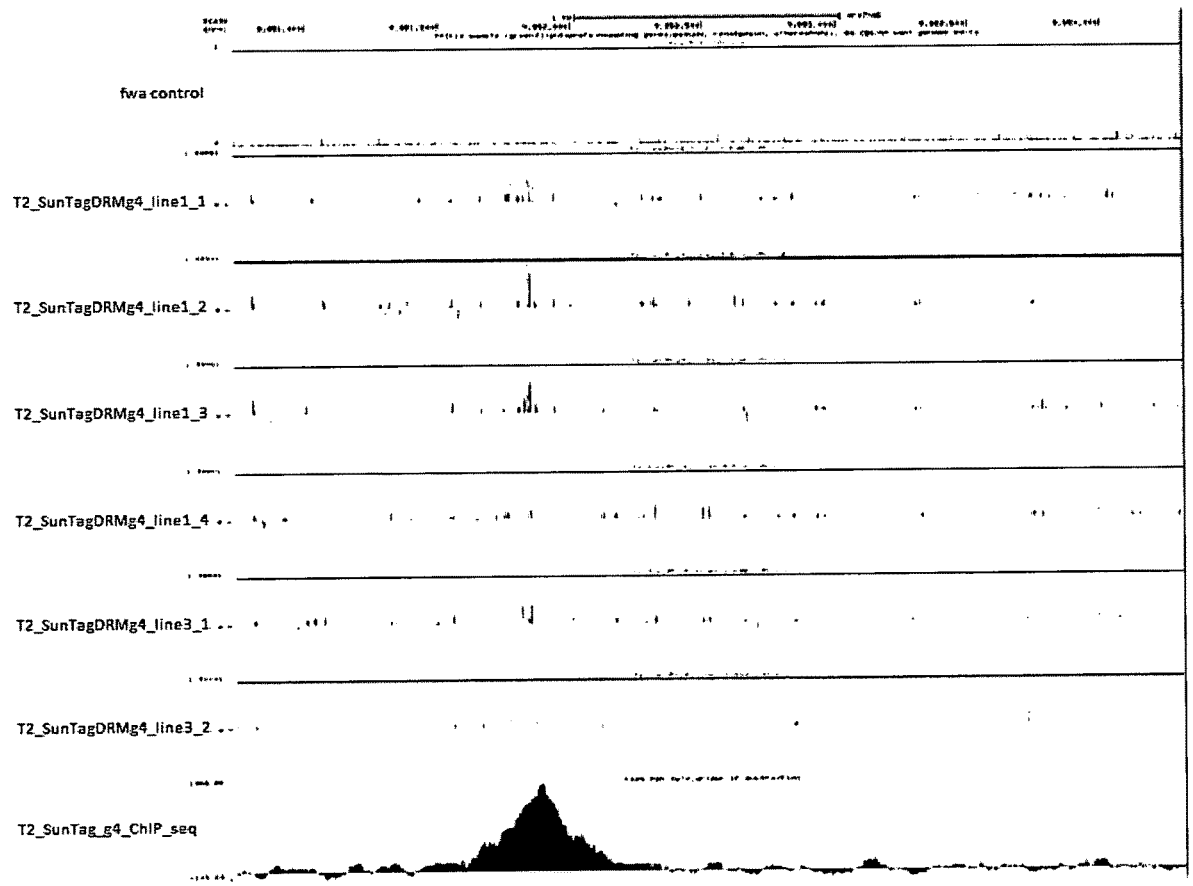
FIG. 25 illustrates SunTag-DRM2-MTase induction of DNA methylation at a genomic off-target. Results are from whole genome bisulfite sequencing from the unmethylated fwa epiallele (top row) and six different T2 plants containing the SunTag-DRM2-MTase system with gRNA4. Shown are CHH methylation tracks for four independent plants from transgenic line 1 and two independent plants from transgenic line 3. Bottom row shows signal from chromatin immunoprecipitation sequencing of dCas9 of a T2 SunTag+gRNA4 line. The methylation is highly localized at the region targeted by dCas9.

ChIP-seq samples were further analyzed to view genome-wide binding of Cas9 to genomic regions. The results illustrated in FIG. 24 demonstrate an enrichment of Cas9 over the FWA promoter. ChIP-seq analysis also revealed only one major off-target of gRNA4 (FIG. 25). This off-target contained a PAM sequence+14 base pairs that were complementary to gRNA4. As can be seen in FIG. 25, this off-target in the SunTag DRM2-MTase+gRNA4 lines was also hypermethylated (mostly in the CHH context) as compared to an fwa-4 control.

Overall, the results suggest that, in the SunTag DRM2-MTase lines containing a gRNA that targets the FWA promoter (gRNA4), the gRNA is able to successfully guide Cas9 to the FWA locus, and that DRM2-MTase is then able to induce methylation of FWA.

Example 10: Additional Zinc Finger Proteins (ZFPs) Fused to DRM2-MTase

This Example describes the use of additional Zinc Finger Proteins (ZFPs) fused to the NtDRM2 methyltransferase domain to methylate the promoter region of the *Arabidopsis* SUPERMAN gene.

Materials and Methods

Different artificial Zinc Finger Proteins (ZFPs) were designed as described in Segal et al. 2003; Kolb et al. 2005, and Johnson et al. 2014 to bind to the promoter of *Arabidopsis* SUPERMAN. The resulting sequences were plant-codon optimized and synthesized (IDT technologies). The new ZFPs were cloned in a modified pMDC123 plasmid, between the UBQ10 promoter and a cassette containing 3×Flag, followed by the NtDRM2 Methyltransferase domain (DRM2-MTase). The resulting construct was transformed in *agrobacterium* and wild type Col0 *Arabidopsis* plants were transformed by the floral dip method.

One of the ZFP expression cassettes is called pMDC_UBQ10::SUP-ZF1_3×Flag_DRM2_MTase. This cassette contains a UBQ10 promoter, SUP1-ZF1, 3×FLAG, and DRM2-MTase. The sequence of this cassette is presented in SEQ ID NO: 843. The amino acid sequence of the fusion protein encoded by this cassette (SUP-ZF1_DRM2-MTase) is presented in SEQ ID NO: 844. The amino acid sequence of SUP-ZF1 is presented in SEQ ID NO: 845. The fusion protein includes an N-terminal SUP-ZF1, intervening 3×FLAG, and DRM2-MTase (C-terminal).

Another of the ZFP expression cassettes is called pMDC_UBQ10::SUP-ZF3_3×Flag_DRM2-MTase. This cassette contains a UBQ10 promoter, SUP1-ZF3, 3×FLAG, and DRM2-MTase. The sequence of this cassette is presented in SEQ ID NO: 846. The amino acid sequence of the fusion protein encoded by this cassette (SUP-ZF3_DRM2-MTase) is presented in SEQ ID NO: 847. The amino acid sequence of SUP-ZF3 is presented in SEQ ID NO: 848. The fusion protein includes an N-terminal SUP-ZF3, intervening 3×FLAG, and DRM2-MTase (C-terminal).

Results

Figure 26:
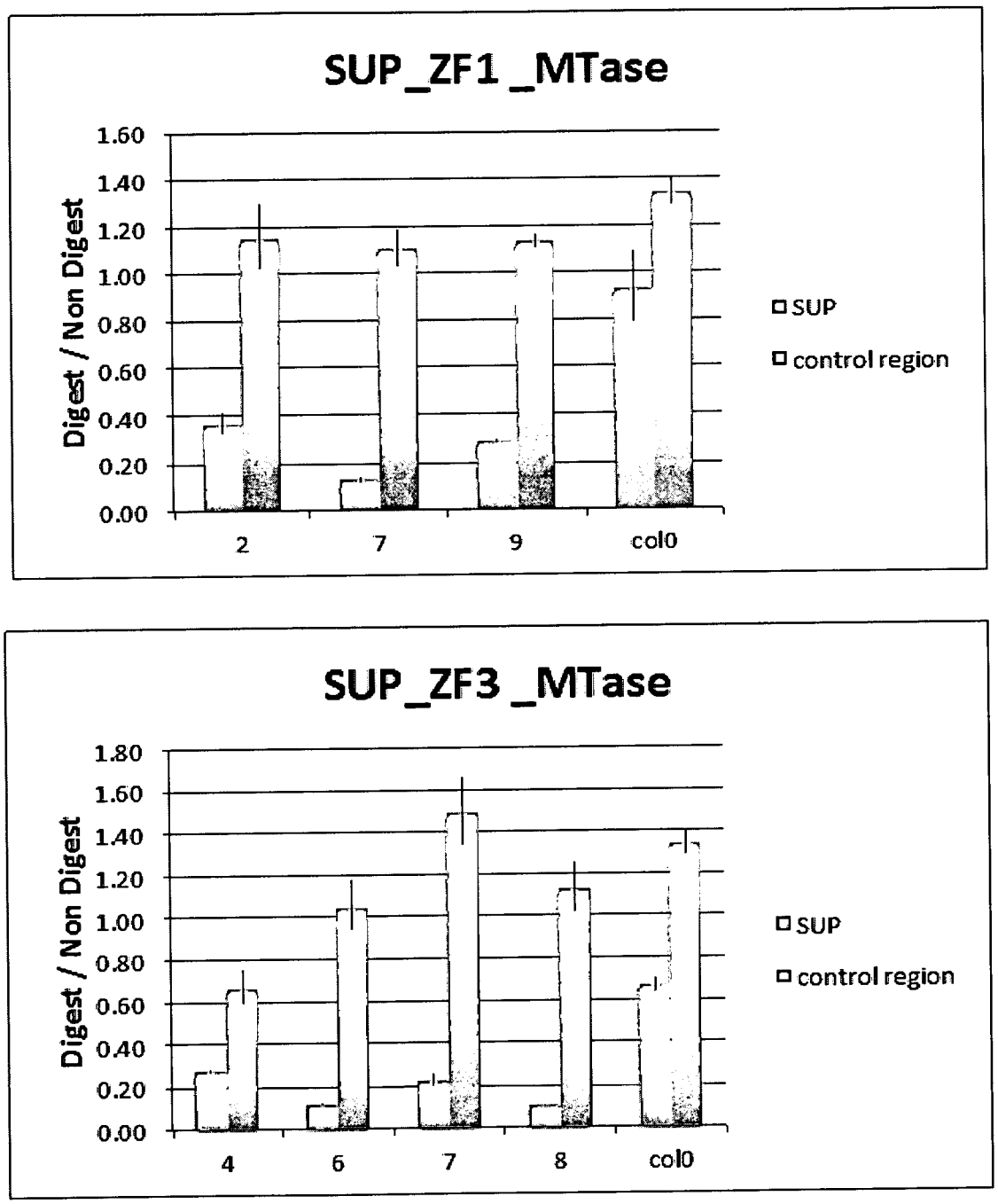
FIG. 26 illustrates McrBC PCR of samples expressing an artificial zinc finger fused to DRM2-Mtase (ZF_DRM2-MTase) designed to target the promoter of SUPERMAN gene. Blue bars represent the ratio of Digested vs Non-digested DNA samples from 3 independent T1 transgenic plants expressing the SUP-ZF1_DRM2-MTase, or 4 different transgenic lines expressing the SUP-ZF3_DRM2-MTase, together with a wild type Col0 control using oligos specific for the SUPERMAN promoter. Red bars represent the ratio of Digested vs Non-digested of the same samples using oligos specific for a control region, not targeted by the fusion protein.

DNA methylation of 10 individual transgenic T1 plants was analyzed by McrBC PCR. DNA was extracted using a CTAB-based method and digested using the DNA methylation sensitive restriction enzyme McrBC that specifically digests methylated DNA. Digested and undigested DNA was amplified by real-time qPCRs using oligos designed to amplify the ZFP targeted regions. A low Digested/Non-digested ratio indicates the presence of methylation at the targeted loci. A control region that is not targeted by the ZFP was used as a negative control. The results indicate methylation at the target region using both SUP-ZF1 and SUP-ZF3 when either is individually fused to DRM2-Mtase (FIG. 26).

Figure 27:
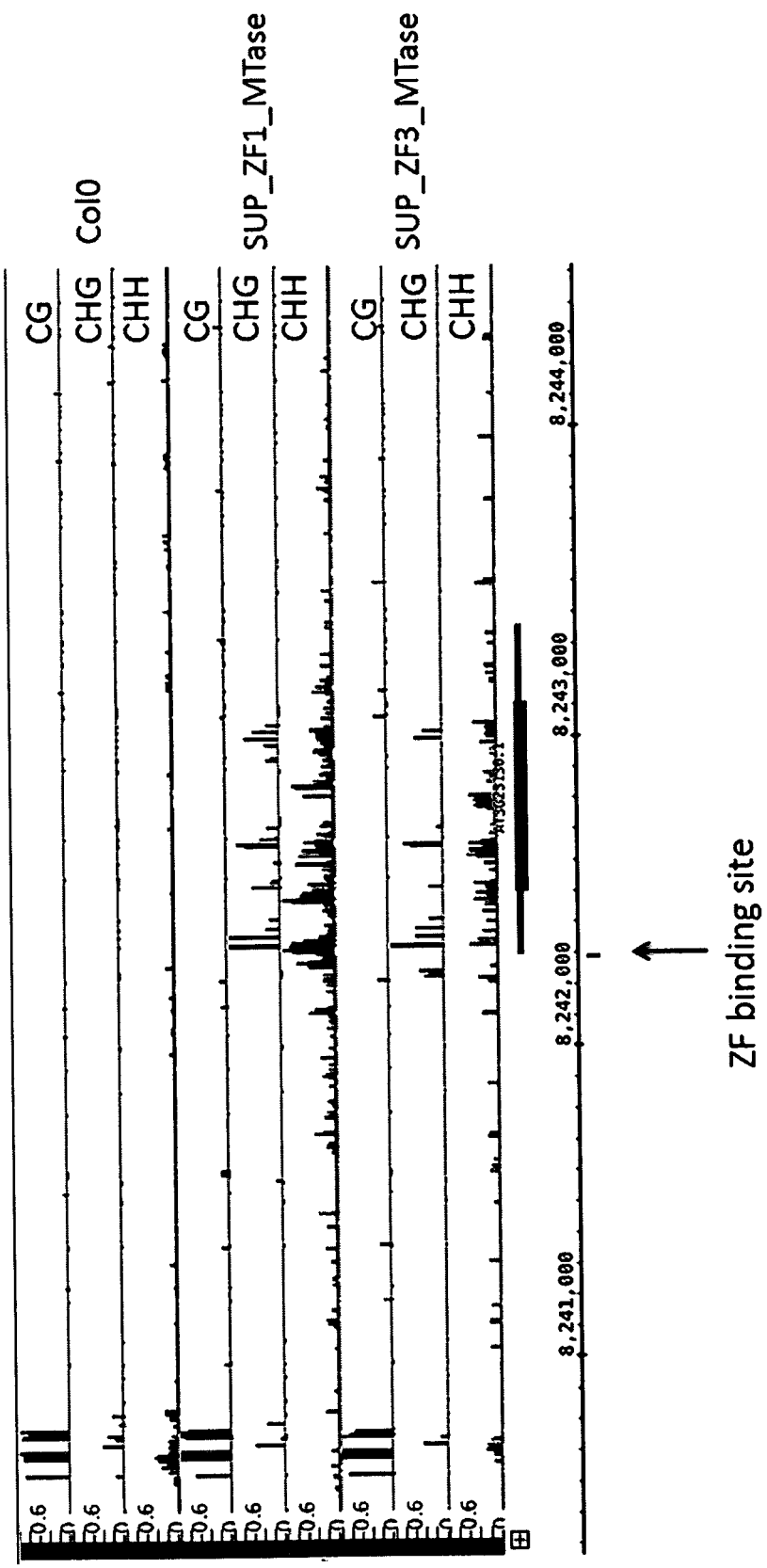
FIG. 27 illustrates whole genome bisulfite sequencing analysis. Screenshot of the region including the SUPERMAN gene showing methylation in different contexts (CG, CHG and CHH, where H is C, T or A) of Col wild type control plants, one line expressing SUP-ZF1_DRM2-MTase and one line expressing SUP-ZF3_DRM2-MTase. SUP-ZF1 and SUP-ZF3 Zinc Fingers bind to an overlapping sequence, with SUP-ZF1 targeted to an 18 base pair sequence and SUP-ZF3 targeted to a 15 base pair sequence. The SUP-ZF1 binding site is indicated with a pink square under the SUPERMAN promoter.

The presence of methylation at the SUPERMAN gene was also confirmed using whole genome bisulfite sequencing. DNA from leaves of the different lines expressing the respective ZFP fused to NtDRM2-MTase was extracted by a CTAB-method. Libraries for whole genome bisulfite sequencing were prepared using the Ovation Ultralow methyl-seq kit (Nugen) and sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used. The results indicate methylation at the target region using both SUP-ZF1 and SUP-ZF3 when either is individually fused to DRM2-Mtase (FIG. 27).

Example 11: DNA Methylation Targeting at FWA with Various Factors

This Example describes additional data showing DNA methylation targeting at FWA with various factors.

Materials, Methods, and Results

DNA from leaves of the different lines expressing ZF108 fused to various factors was extracted by a CTAB-method. Libraries for whole genome bisulfite sequencing were prepared using the Ovation Ultralow methyl-se kit (Nugen) and sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used.

Figure 28:
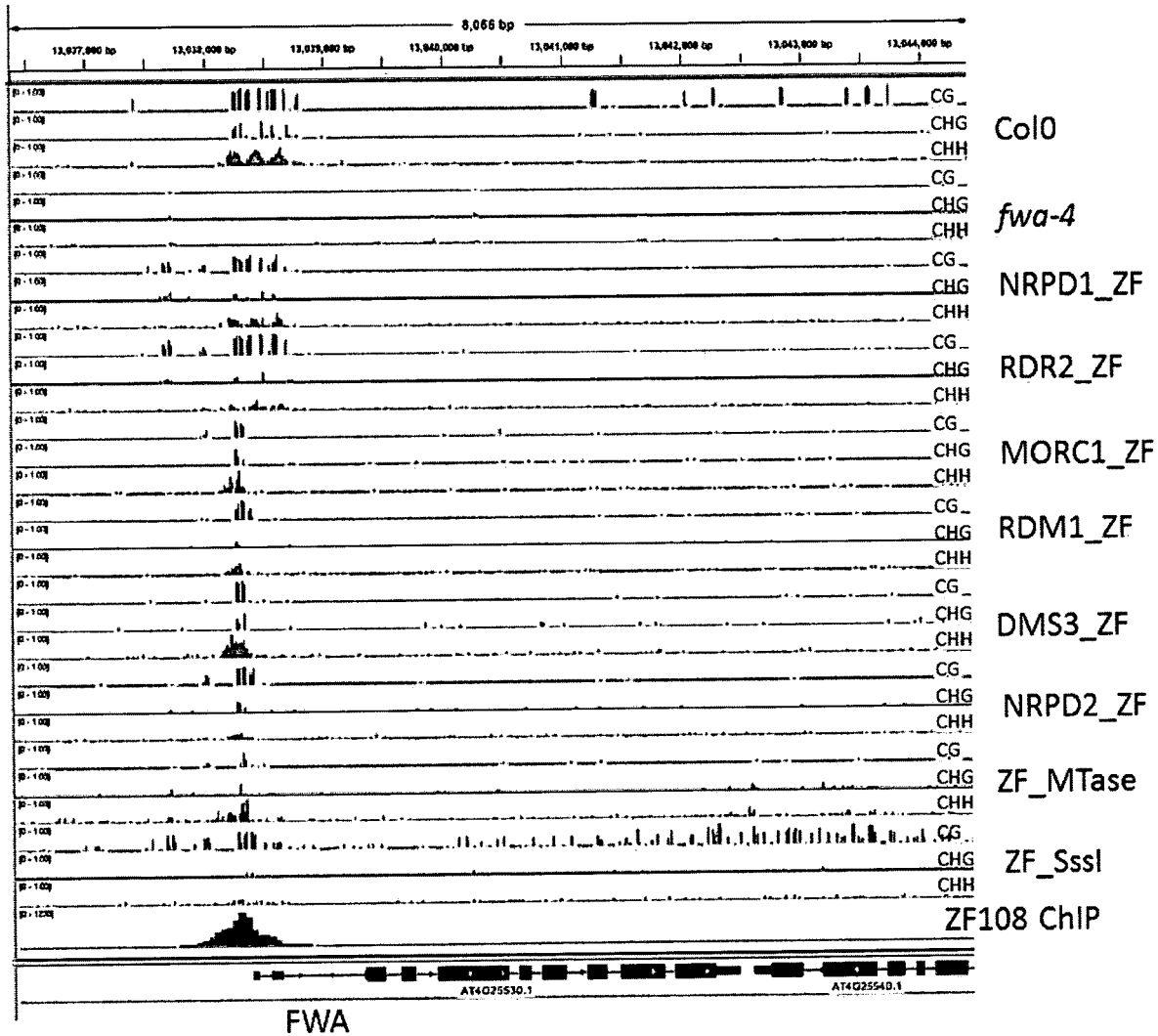
FIG. 28 illustrates a screenshot of the FWA region showing methylation levels of different lines expressing ZF108 fused to various proteins, along with control lines (Col0 and fwa-4). Different tracks indicate different cytosine methylation context (CG, CHG and CHH, where H is C, A or T). ZF108 Chromatin Immunoprecipitation (ChIP) indicates the specific location of ZF108 binding to the FWA promoter.

Results are presented in FIG. 28. The results demonstrate that a number of proteins, including NRPD1, RDR2, MORC1, RDM1, DMS3, NRPD2, DRM2-MTase, and SssI, when fused to the ZF108 zinc finger, were able to target methylation at the FWA promoter. ZF108 chromatin immunoprecipitation demonstrates that ZF108 was bound at the targeted region of the FWA locus.

Example 12: Off-Targets of ZF108

Figure 29:
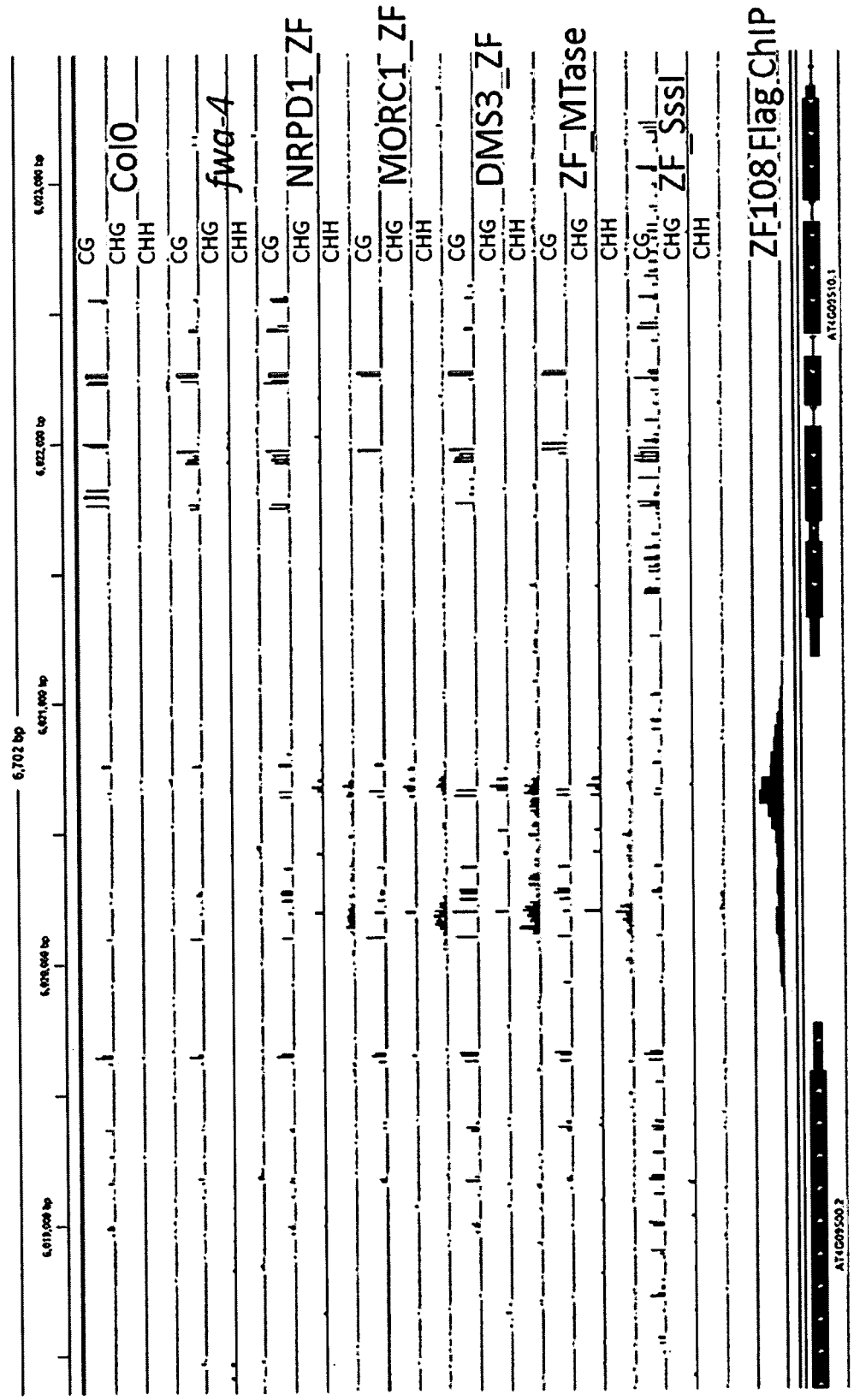
FIG. 29 illustrates a screenshot at a ZF108-related locus showing methylation levels of different lines expressing ZF108 fused to various proteins, along with control lines (Col0 and fwa-4). Different tracks indicate different cytosine methylation context (CG, CHG and CHH, where H is C, A or T). ZF108 Chromatin Immunoprecipitation (ChIP) indicates the specific location of ZF108 binding to a location near the At4g09510 gene, which contains a DNA sequence which is very similar to the sequence targeted at FWA.
Figure 30:
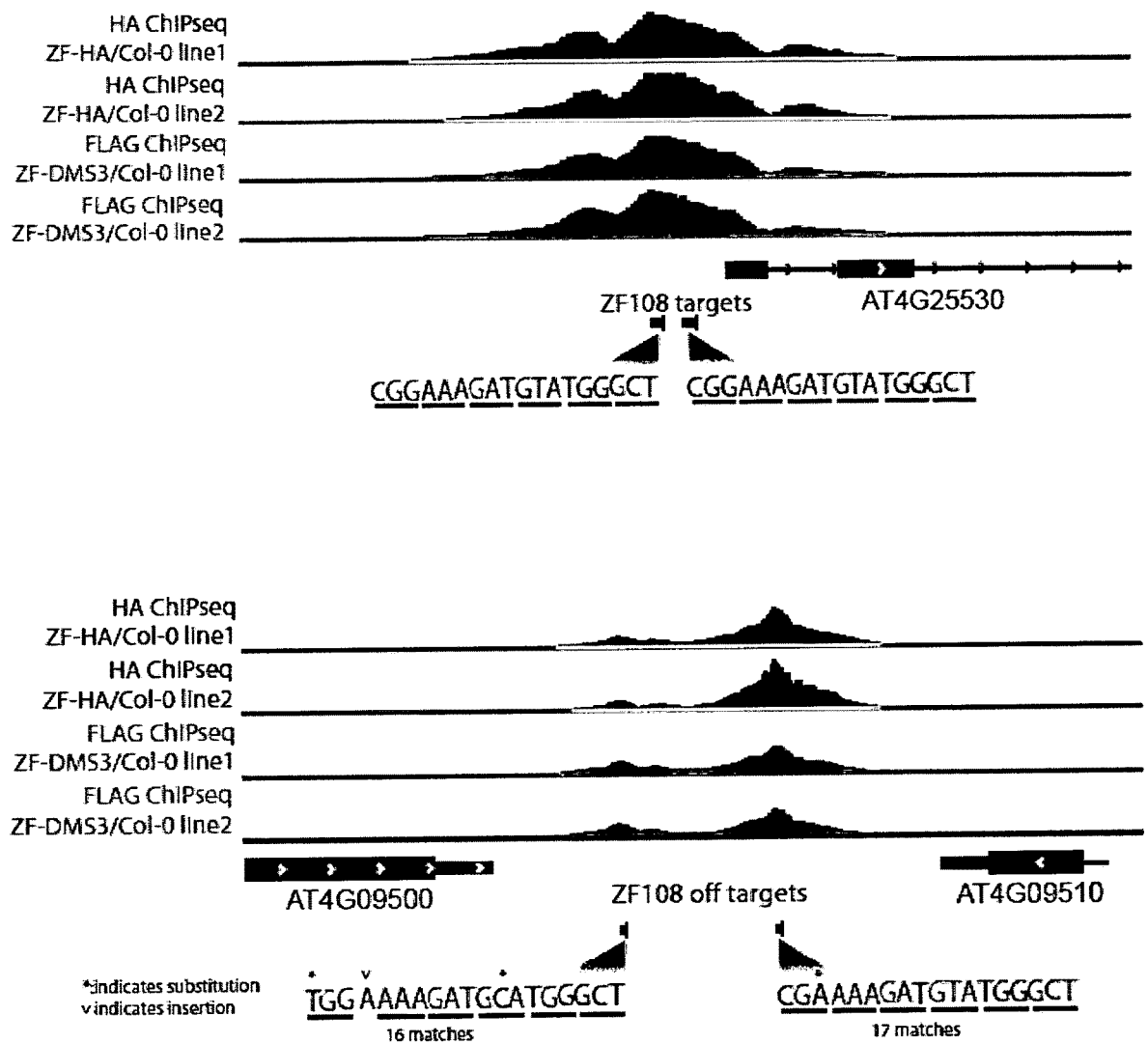
FIG. 30 illustrates screenshots showing ChIP-seq signals from ZF108-HA lines and ZF108-DMS3 lines in either the region of the designed zinc finger binding site (CGGAAAGATGTATGGGCT (SEQ ID NO: 899)) in the FWA promoter (top panel), or at a region on chromosome 4 containing two DNA sequences which are very close in sequence to the designed ZF108 sequence (bottom panel). The FWA region contains two sequences (SEQ ID NO: 899) that are identical to the ZF108 binding sites. The additional region on chromosome 4 contains two sequences (SEQ ID NO: 900 and 901) that contain 17 matches to the ZF108 binding site.
Figure 31:
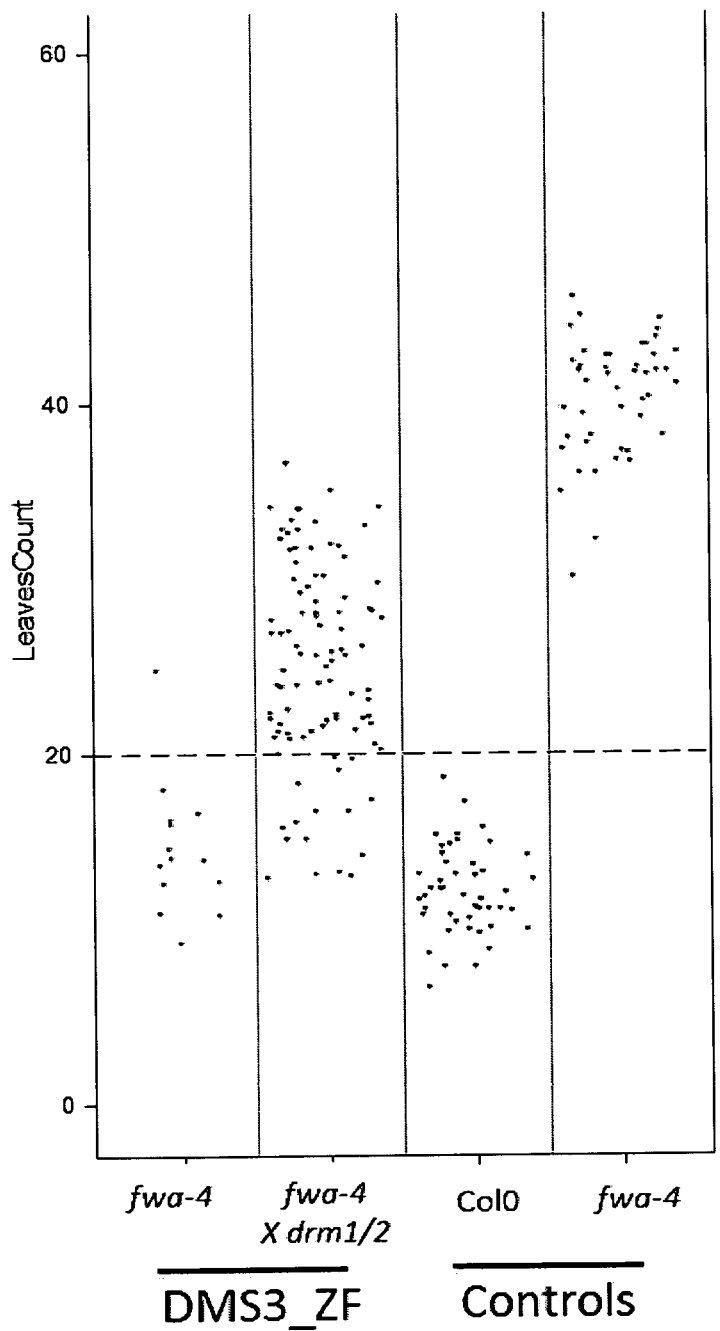
FIG. 31 illustrates flowering time of DMS3-ZF T1 plants. Flowering time of T1 plants in fwa-4 or fwa-4 crossed with drm1/2 "drm12". Wild type "Col0" and fwa-4 "fwa" controls were also measured. Flowering time of T1 plants was scored as total number of leaves after flowering.
Figure 32:
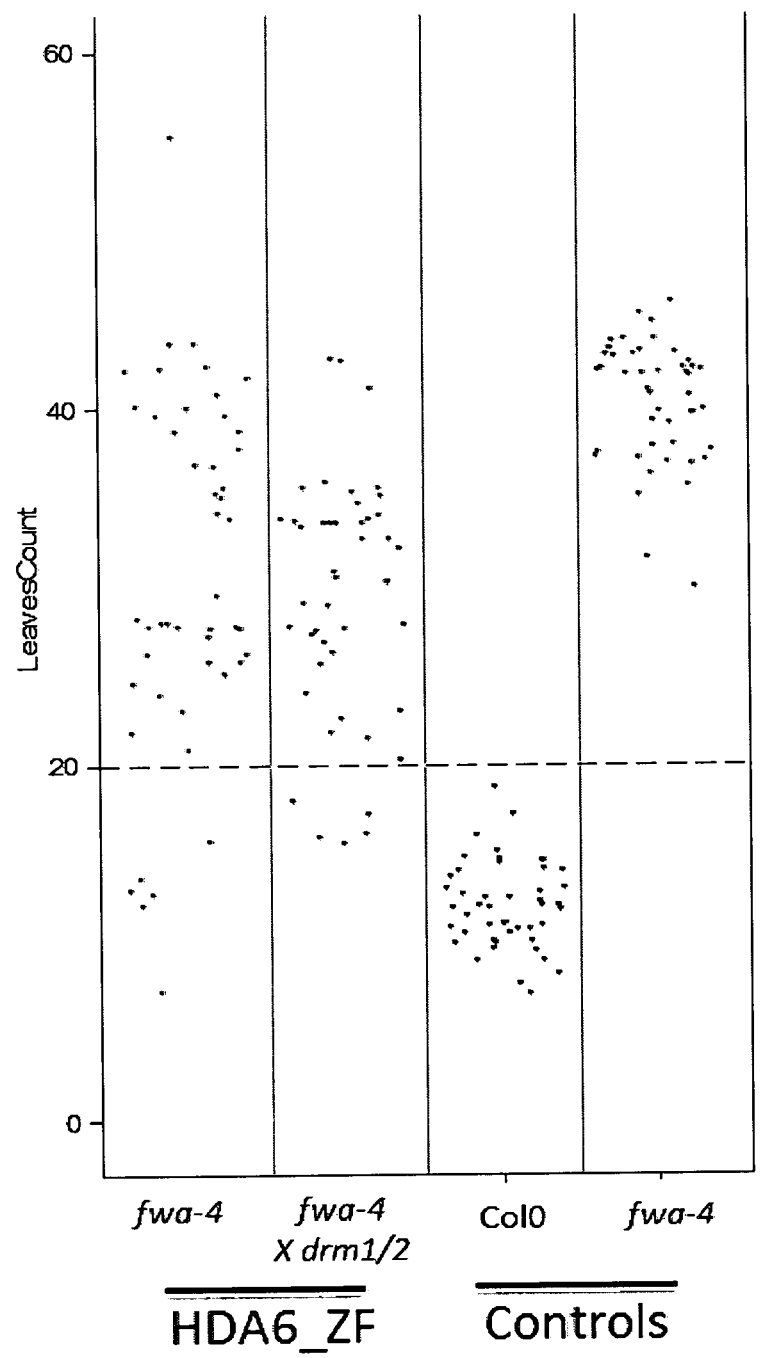
FIG. 32 illustrates flowering time of HDA6-ZF T1 plants. Flowering time of T1 plants in fwa-4 or fwa-4 crossed with drm1/2 "drm12". Wild type "Col0" and fwa-4 "fwa" controls were also measured. Flowering time of T1 plants was scored as total number of leaves after flowering.
Figure 33:
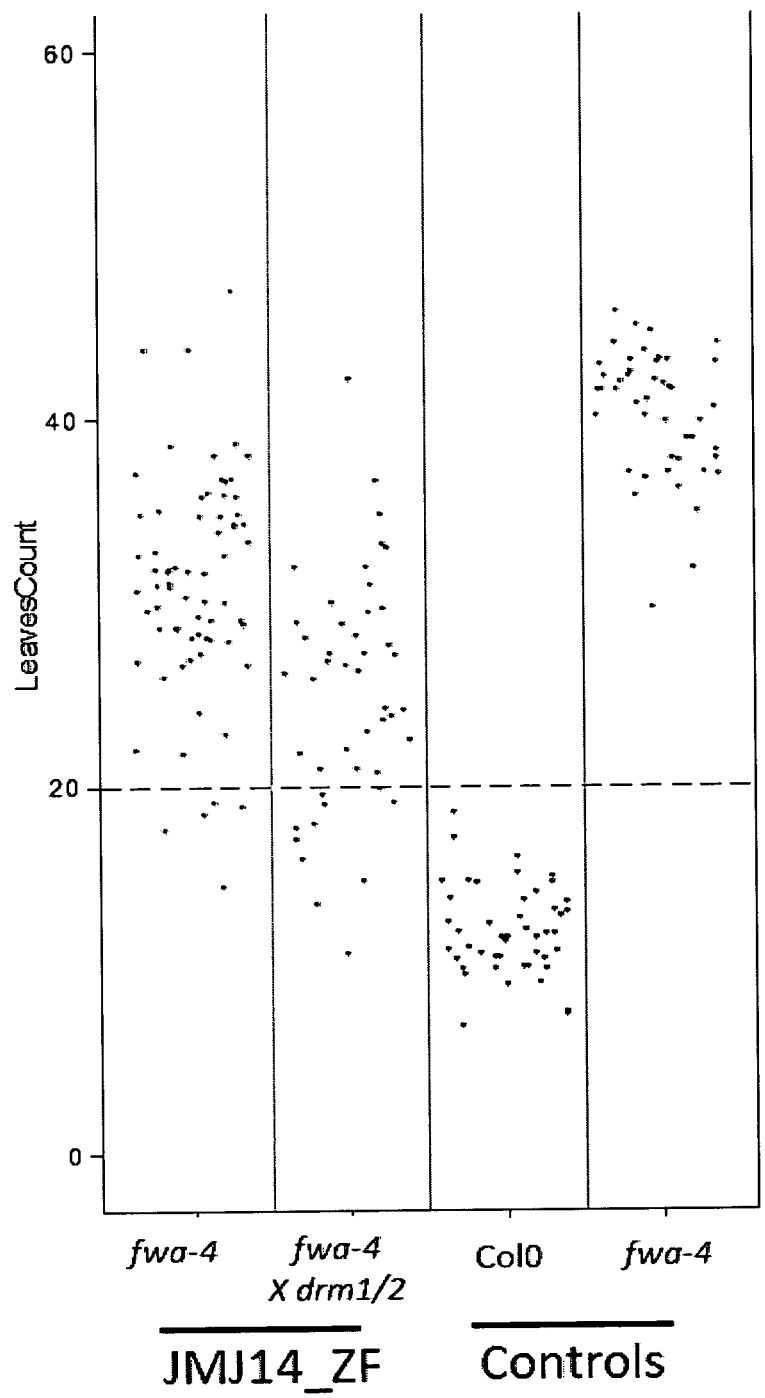
FIG. 33 illustrates flowering time of JMJ14-ZF T1 plants. Flowering time of T1 plants in fwa-4 or fwa-4 crossed with drm1/2 "drm12". Wild type "Col0" and fwa-4 "fwa" controls were also measured. Flowering time of T1 plants was scored as total number of leaves after flowering.
Figure 34:
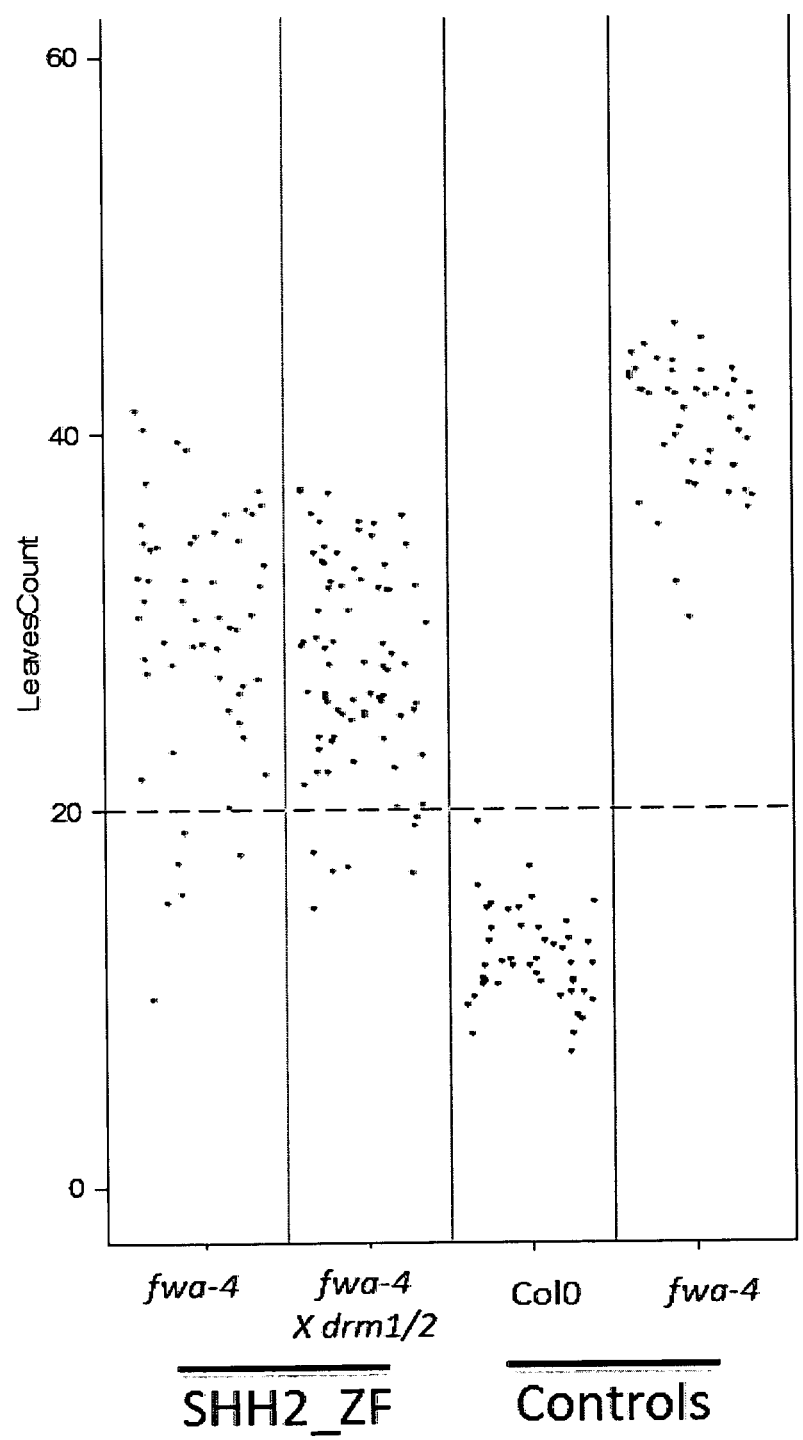
FIG. 34 illustrates flowering time of SHH2-ZF T1 plants. Flowering time of T1 plants in fwa-4 or fwa-4 crossed with drm1/2 "drm12". Wild type "Col0" and fwa-4 "fwa" controls were also measured. Flowering time of T1 plants was scored as total number of leaves after flowering.

This Example illustrates additional regions of the *Arabidopsis* genome targeted by the ZF108 artificial zinc finger.
Materials and Methods DNA from leaves of different lines expressing ZF108 fused to various factors was extracted by a CTAB-method. Libraries for whole genome bisulfite sequencing were prepared using the Ovation Ultralow methyl-seq kit (Nugen) and sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapped reads were used.
Results The results demonstrate DNA methylation targeting at a second location in the *Arabidopsis* genome with two sequences very similar to the ZF108 target locus. Both Col0 and fwa-4 plants have very little pre-existing methylation at this site, but the ZF108 fusion protein containing plants contain methylation in all three sequence contexts (FIG. 29). A ChIP-seq analysis of the ZF108 zinc finger fused to either the HA tag or a DMS3-FLAG tag shows enrichment of ZF108 at both FWA and this second location with sequences related to the zinc finger binding site (FIG. 30).

Example 13: DNA Methylation-Independent Silencing of Targeted Loci

This Example describes the ability of ZF108 fusions to DMS3, HDA6, JMJ14, SHH2 and SUVR2 to silence FWA and affect flowering time in a DNA methylation-independent manner.
Materials, Methods, and Results Plants expressing ZF108 fused to DMS3, HDA6, JMJ14 or SHH2 (described in Example 6) were transformed into either fwa-4 or fwa-4 drm1 drm2 triple mutants, defective in the two de-novo methyltransferases in *Arabidopsis* and, therefore, incapable of de-novo methylating any sequences. Importantly, plants expressing the different ZF108 fusions in both mutant backgrounds were able to cause an early flowering phenotype, suggesting that they were able to repress FWA expression and cause early flowering, even in the absence of DNA methylation (fwa-4×drm1/2) (FIG. 31, FIG. 32, FIG. 33, and FIG. 34).

Figure 35:
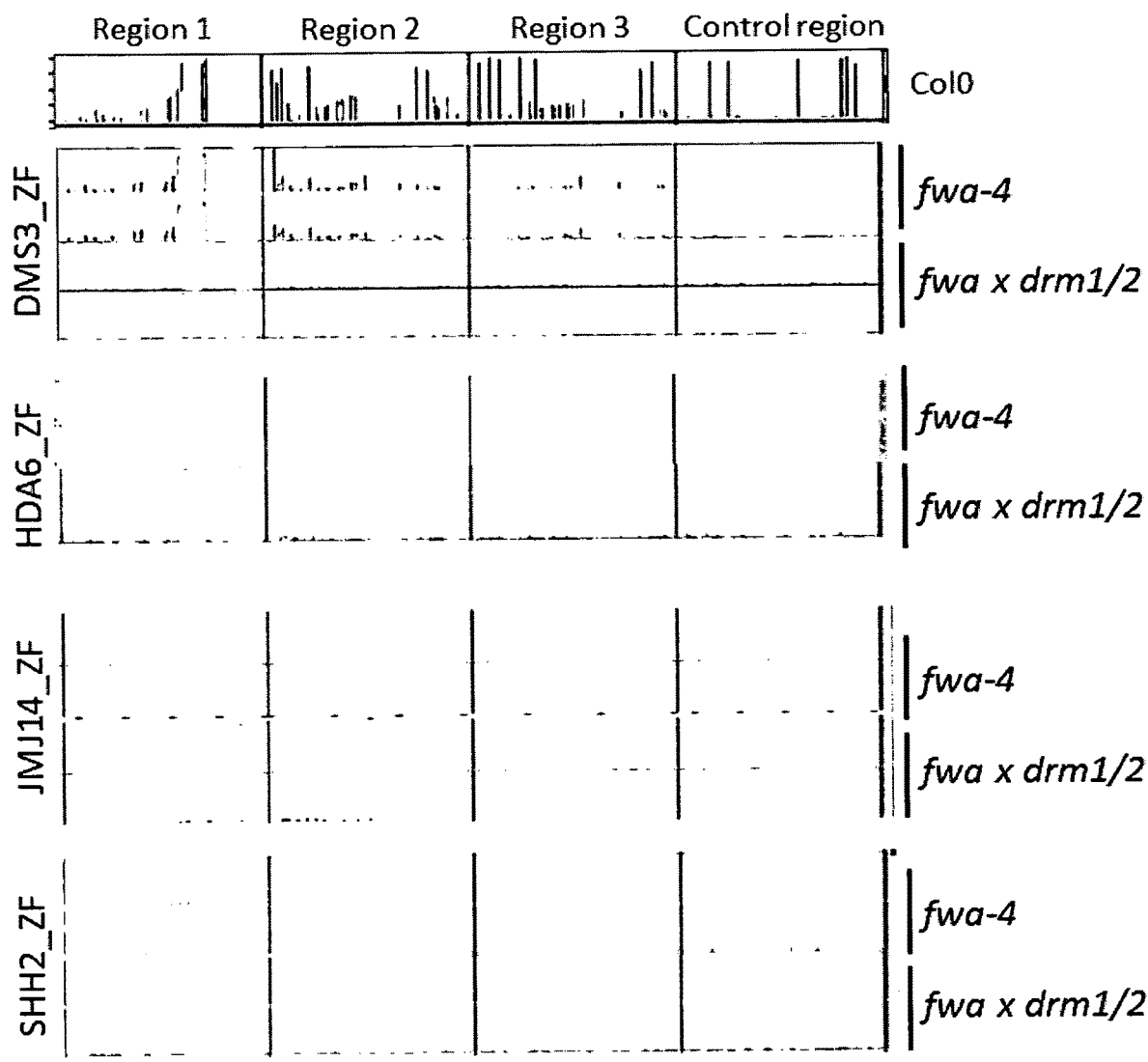
FIG. 35 illustrates DNA methylation analysis of two early flowering T1 plants in either fwa-4 or fwa-4 crossed with drm1/2 "drm12", analyzed by BS-PCR. Methylation levels at 3 different regions of the FWA promoter and one control region, corresponding to a downstream gene, are shown.
Figure 36:
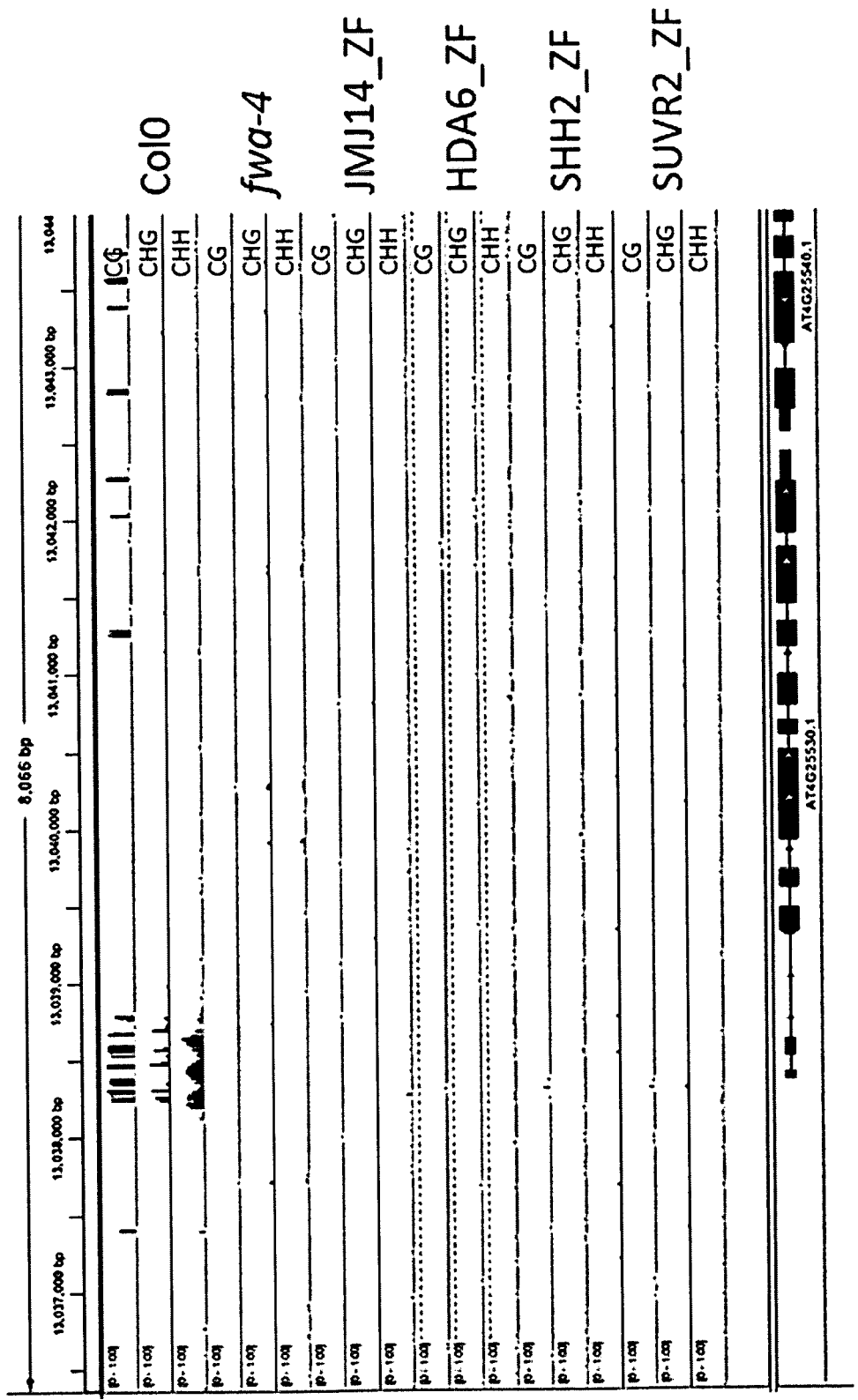
FIG. 36 illustrates a screenshot of Whole-Genome Bisulfite Sequencing data of the FWA promoter region for different lines expressing various ZF108 fusion proteins. Even though these plants displayed an early flowering phenotype indicative of FWA silencing, this data shows that these proteins are capable of causing silencing without inducing DNA methylation of FWA.

To further validate that this effect on flowering time was happening in the absence of DNA methylation, BS-PCR and whole genome bisulfite sequencing were performed as described in previous examples (FIG. 35 and FIG. 36). The results indicate that, indeed, DNA methylation was absent at the FWA promoter in plants expressing the different fusions in both mutant backgrounds, fwa-4 or fwa-4×drm1 2, confirming that these factors can cause early flowering in the absence of DNA methylation. The ZF108-SUVR2 plants also showed no DNA methylation at the FWA gene (FIG. 36), suggesting that SUVR2 is also capable of causing silencing of FWA in the absence of DNA methylation.

In Example 6 herein, it was found that HDA6, JMJ14, SHH2, and SUVR2 did, in that particular case, cause methylation of FWA. However, as elaborated upon in this Example, it has also been found that this induction of methylation by these factors does not always occur. Thus, it appears that these factors can in some cases trigger methylation of FWA, but in most cases do not. Regardless, the data demonstrate that these factors can induce silencing of FWA when targeted to that locus, even in the absence of inducing DNA methylation at that locus.

Example 14: Heritable Silencing Induced by ZF108-SssI

Figure 37:
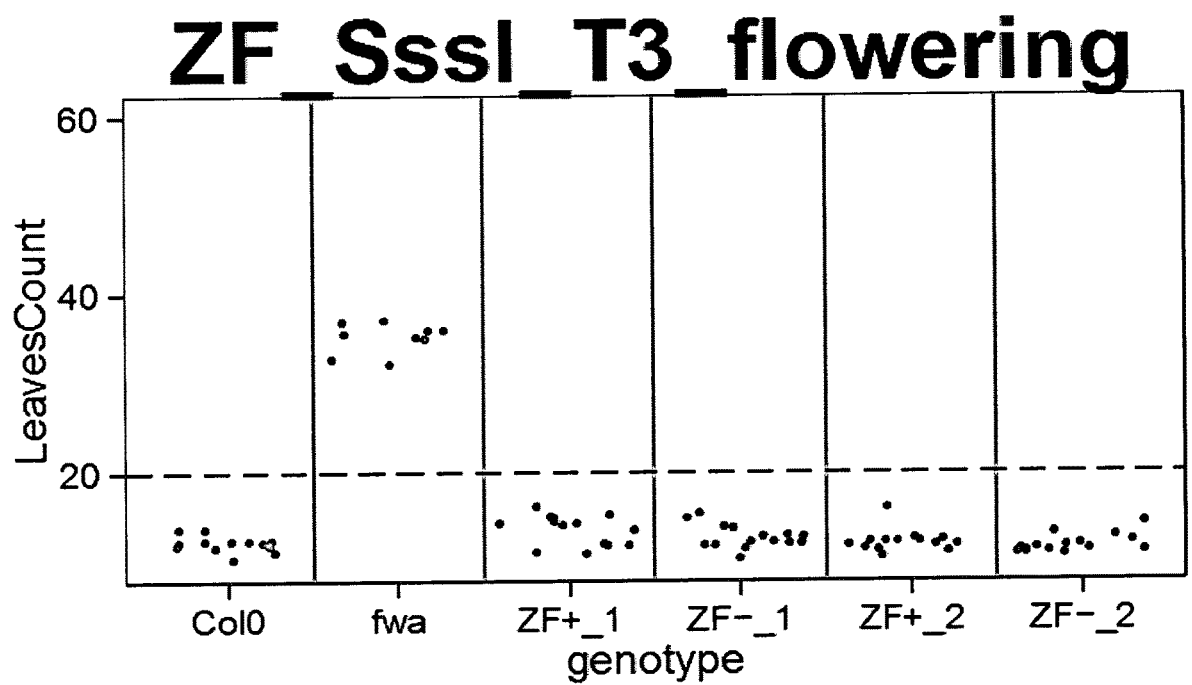
FIG. 37 illustrates flowering time of T3 populations derived from ZF-SssI T2 plants (ZF-SssI transformed into the fwa-4 epimutant) that had the ZF-SssI transgene (ZF+) or had segregated it away (ZF−). Col0 and fwa-4 were used as controls for flowering time.
Figure 38:
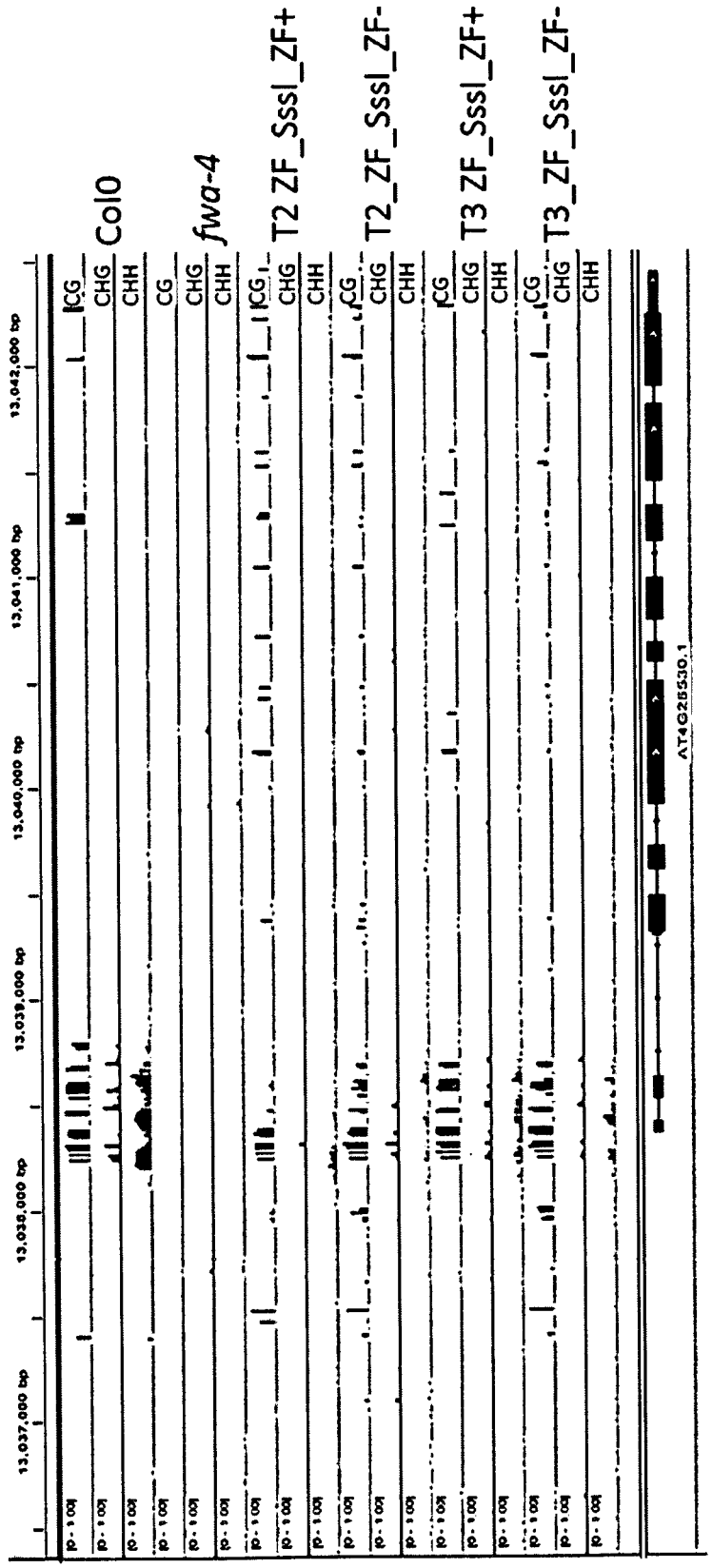
FIG. 38 illustrates a screenshot at the FWA locus of whole genome bisulfite sequencing data corresponding to T2 or T3 plants from a line that expresses ZF108-SssI (ZF+) or where the transgene has been segregated out (ZF−).
Figure 39:
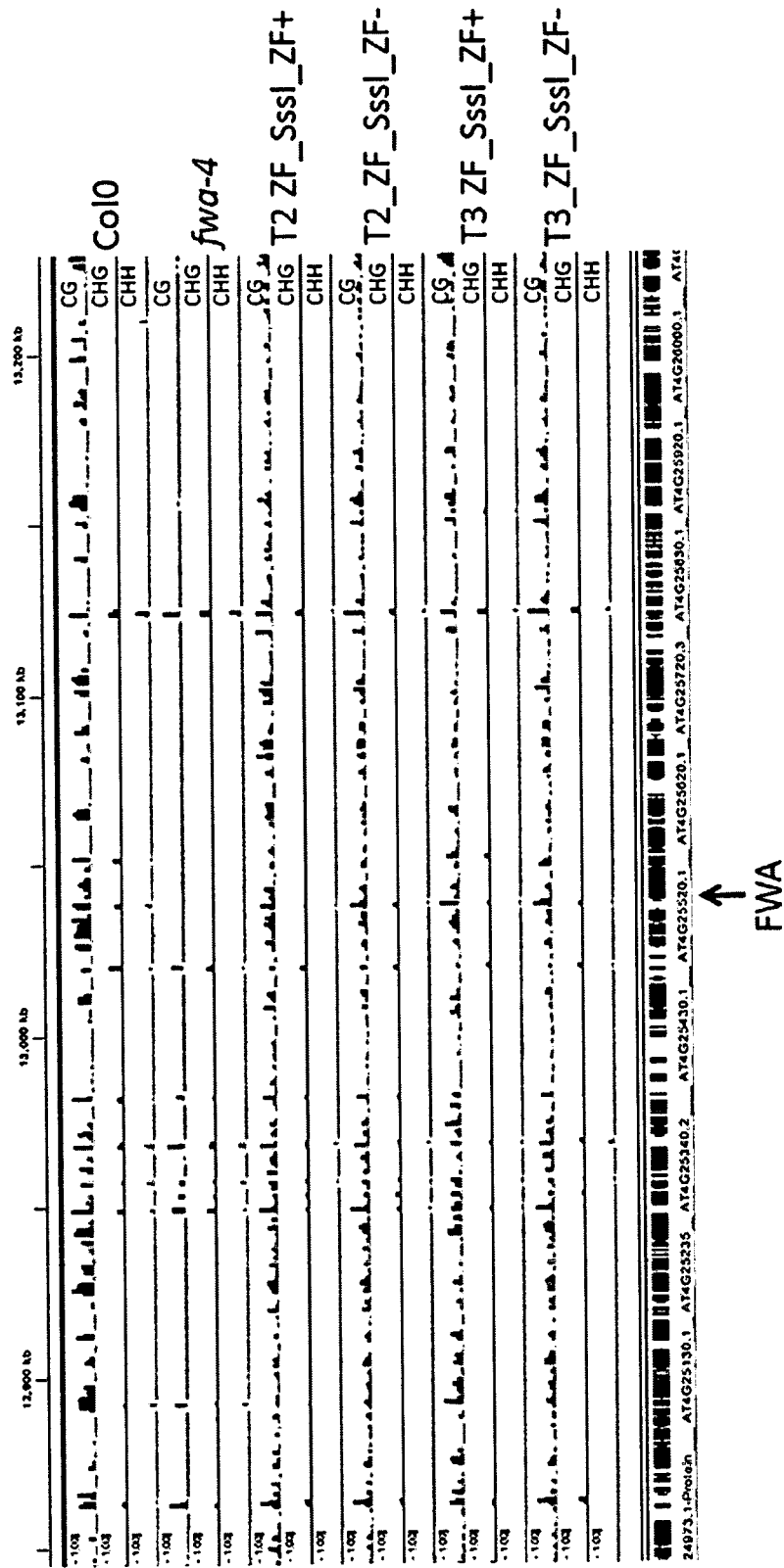
FIG. 39 illustrates a zoomed out view of the region presented in FIG. 38. FWA promoter is indicated with an arrow.

This Example describes the inheritance of DNA methylation and FWA silencing and early flowering in the absence of the ZF108-SssI transgene once it has genetically segregated out.
Materials and Methods DNA from T2 and T3 ZF+ and ZF− plants was extracted by a CTAB-based method and libraries for whole genome bisulfite sequencing were prepared using the Ovation Ultralow methyl-seq kit. Libraries were sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq up to 2 mismatches were allowed and only uniquely mapping reads were used.
Results fwa-4 plants were transformed with the ZF108-SssI transgene. T1 plants were selfed to produce the T2 generation, and individual plants that still contained the transgene (ZF+) or had segregated it out (ZF−) were selected. The T3 progeny of these plants were grown and flowering time was scored and compared to controls, Col and fwa-4. The results show that DNA methylation triggered by ZF108-SssI, and the accompanying transition to early flowering, is maintained even when the transgene is segregated out (FIG. 37, FIG. 38, and FIG. 39). In addition, CG methylation which had been established by ZF108-SssI at many other regions of the genome were also maintained after the ZF108-SssI transgene was segregated away.

The ability of SssI to cause CG methylation throughout the genome as described herein may have applications in restoring methylation in plants. For example, plants that undergo the tissue culture processes normally involved in plant transformation show losses of DNA methylation at hundreds of locations. These losses are heritable, and can cause changes in gene expression (Stroud et al., 2013). It is possible that ZF108-SssI could be used to restore methylation in plants that have undergone tissue culture.

Example 15: Zinc Finger Targeting of MBD9 to FWA

This Example describes the use of MBD9 fused to ZF108 to repress expression of the FWA gene.
Materials and Methods A genomic construct of MBD9, including a 1 Kb promoter region, was cloned into pENTR/D plasmid. Then, a cassette containing 3×Flag and ZF108 was cloned downstream of MBD9 and the resulting construct was transferred into a modified pEG302 binary vector. This construct was transformed into *Agrobacterium* and introduced in fwa-4 plants by the floral dip method.

The nucleic acid sequence of the expression cassette, MBD9_3×Flag_ZF108, is set forth in SEQ ID NO: 849. The amino acid sequence of the fusion protein encoded by this cassette is set forth in SEQ ID NO: 850.

T1 transgenic plants, together with Col0 and fwa-4 controls, were grown and flowering time was scored by counting the number of total leaves.

Results

ZF108-MBD9 plants displayed an early flowering phenotype in 6 out of 38 tested plants (Table 15A). This indicates that MBD9 is able to cause silencing of FWA.

TABLE 15A

Flowering Time Results

| | early flowering | late flowering |
|---|---|---|
| MBD9-ZF | 6 | 32 |

Figure 40:
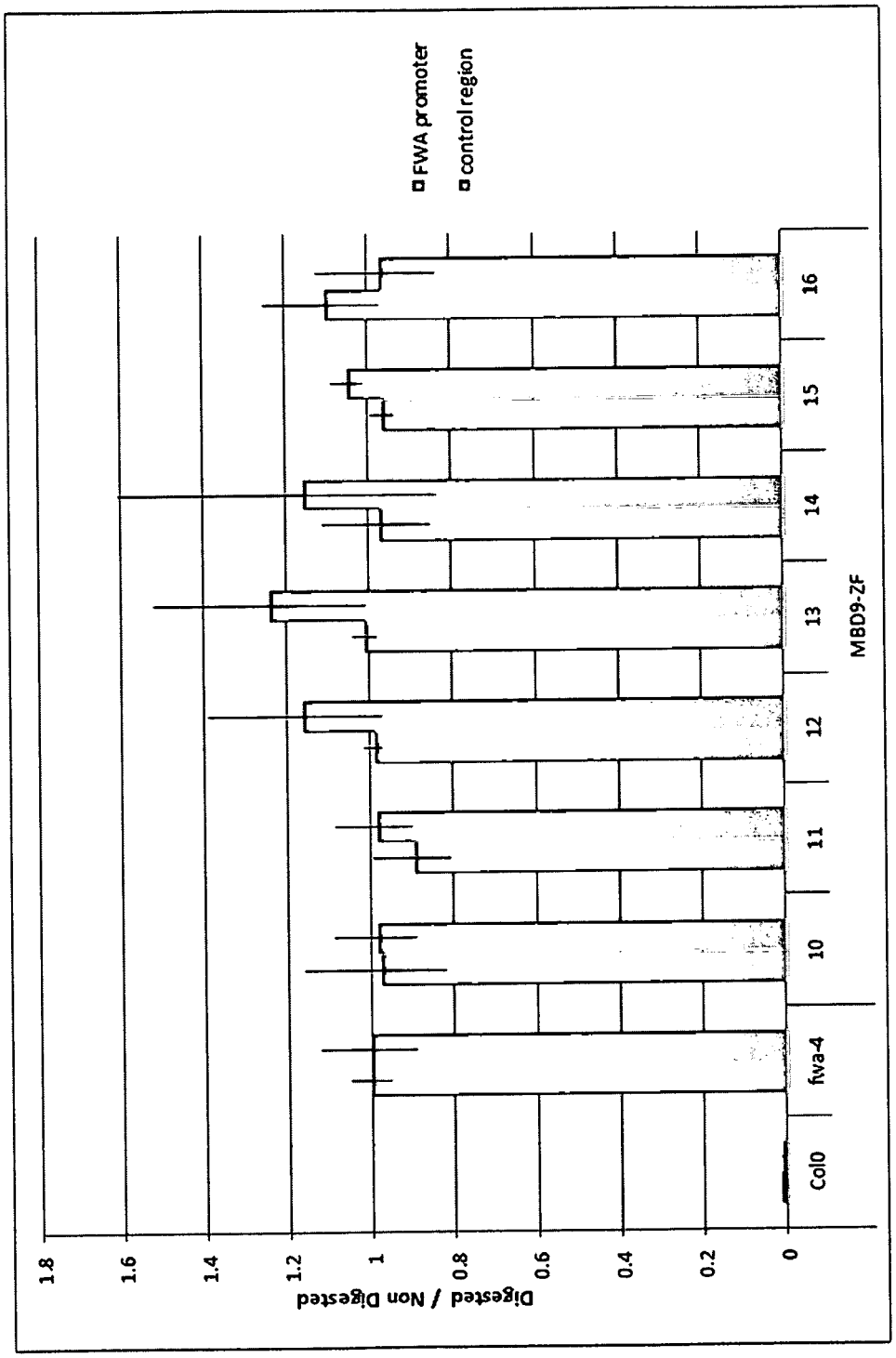
FIG. 40 illustrates McrBC-PCR of Col0, fwa-4 and 7 independent T1 transgenic lines expressing MBD9-ZF. qPCR was performed using oligos specific for the FWA promoter or a control region. The ratio between digested and undigested samples is shown.

In order to determine if the FWA promoter is being methylated in these lines, an McrBC PCR experiment was done using the methylation sensitive restriction enzyme McrBC. Briefly, genomic DNA from Col0, fwa-4 and 7 independent T1 lines expressing MBD9-ZF, 6 of them showing an early flowering phenotype, was digested with McrBC for 4h at 37° C. The same amount of DNA was mock-digested (no restriction enzyme) under the same conditions. qPCR using the resulting samples was performed with oligos that amplify the FWA promoter, or a control region that, similar to FWA promoter, shows methylation in Col0 but not in fwa-4. Then, the ratio between digested and undigested samples was calculated. The results clearly indicate that the lines expressing MBD9-ZF do not show methylation at the FWA promoter (FIG. 40). MBD9 is thus able to cause silencing of FWA in the absence of DNA methylation.

Example 16: Targeting of DRM2-MTase to the SUPERMAN Locus Using the SunTag System This Example demonstrates the targeting of DRM2-MTase to the SUPERMAN locus using the SunTag system and the subsequent establishment of DNA methylation and silencing.

Materials and Methods

Materials and Methods used in this Example are similar to the Materials and Methods described in Example 9. One notable difference is that two different U6-driven guide RNAs are used to target SUPERMAN, as opposed to targeting FWA as in Example 9.

For targeting SUPERMAN, two sgRNA expression cassettes were constructed and were present on the same binary vector described in Example 9. Each cassette was driven by the U6 promoter (SEQ ID NO: 860). The two protospacer sequences are presented in SEQ ID NO: 851 and SEQ ID NO: 852. The sgRNA backbone sequence is presented in SEQ ID NO: 853.

Results

Following confirmation that the SunTag DRM2-MTase expression system components were being expressed and localized to the nucleus, various plant lines were evaluated to assess targeting of DRM2-MTase to SUPERMAN and induction of methylation. Various T1 lines housing the SunTag DRM2-MTase construct that contains the two guides (which target the promoter region of SUPERMAN) were evaluated for methylation levels at SUPERMAN's promoter region.

Figure 42:
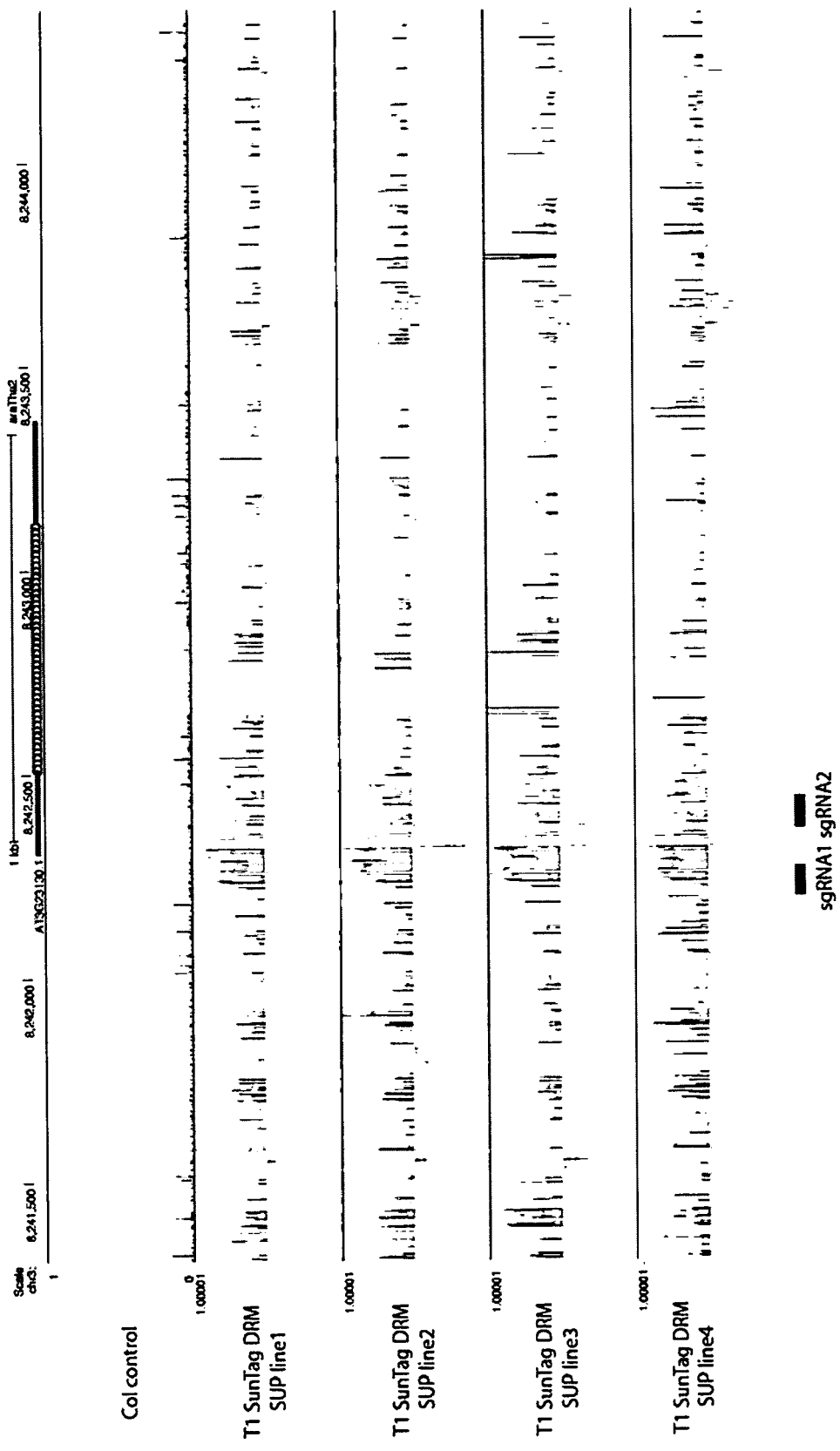
FIG. 42 illustrates whole-genome bisulfite sequencing data of T1 SunTag DRM2-MTase (DRM) *Arabidopsis thaliana* transgenic plants (Columbia background) with two sgRNAs driven by the U6 promoter targeting SUPERMAN (SUP). Shown in the figure are CHH methylation tracks of the Col control, T1 SunTag DRM SUP line1, T1 SunTag DRM SUP line2, T1 SunTag DRM SUP line3, and T1 SunTag DRM SUP line4. SUPERMAN is annotated at the top of the tracks. Targeted methylation is present in SUPERMAN's promoter and extends through the transcriptional start site.
Figure 43:
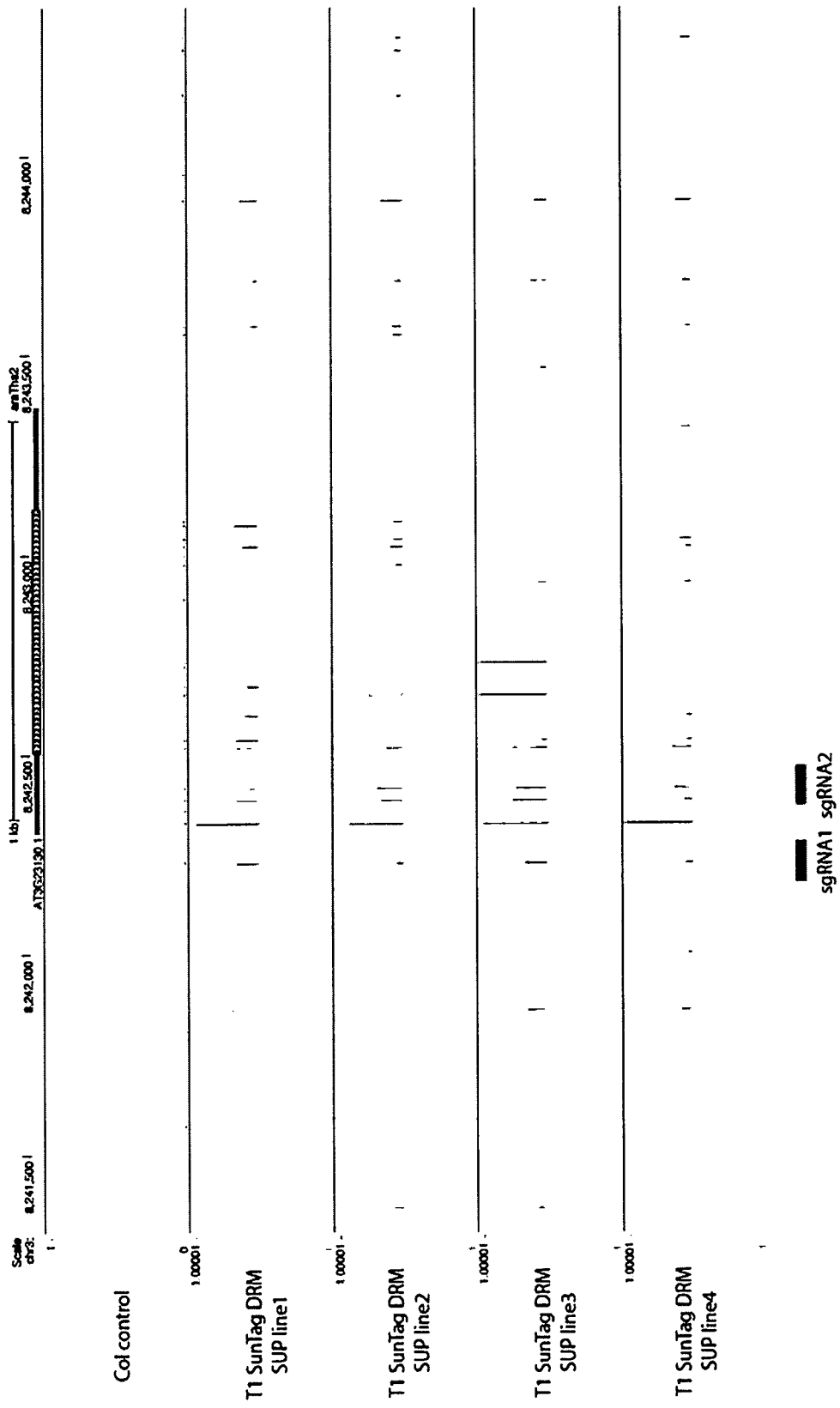
FIG. 43 illustrates whole-genome bisulfite sequencing data of T1 SunTag DRM2-MTase (DRM) *Arabidopsis thaliana* transgenic plants (Columbia background) with two sgRNAs driven by the U6 promoter targeting SUPERMAN (SUP). Shown in the figure are CHG methylation tracks of the Col control, T1 SunTag DRM SUP line1, T1 SunTag DRM SUP line2, T1 SunTag DRM SUP line3, and T1 SunTag DRM SUP line4. SUPERMAN is annotated at the top of the tracks. Targeted methylation is present in SUPERMAN's promoter and extends through the transcriptional start site.
Figure 44:
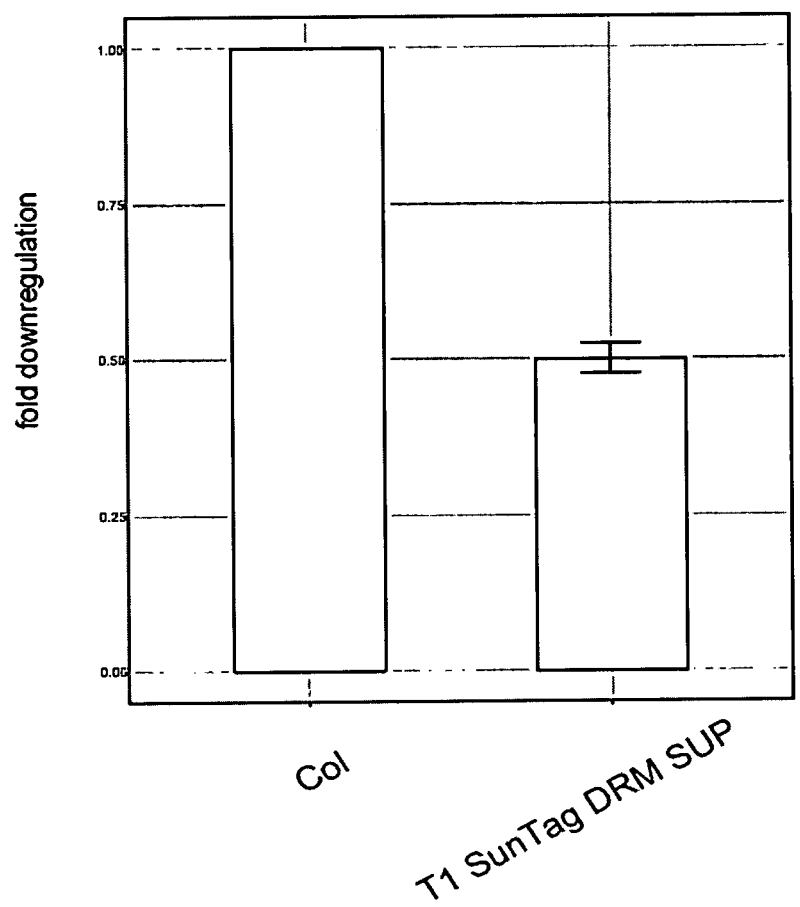
FIG. 44 illustrates qRT-PCR expression data of SUPERMAN in flowers of T1 SunTag DRM SUP line1 plants as compared to the Col control. Transgenic plants show about a 2-fold downregulation of SUPERMAN transcripts relative to Col. Error bars indicate SEM of two replicates.

Multiple plants from multiple independent T1 SunTag DRM2-MTase+sgRNA1/2 lines exhibited increased CHH and CHG methylation at SUPERMAN's promoter region as compared to Col controls. FIG. 42 and FIG. 43 show examples of the increased CHH and CHG methylation, respectively. As shown in the figures, there is no methylation present in the controls, and the SunTag construct successfully introduces methylation at the targeted sites.

qRT-PCR was performed to check for repression of SUPERMAN transcripts in flowers of T1 lines as compared to Col controls. As shown in FIG. 44, line 1 showed downregulation of SUPERMAN expression by 2-fold as compared to the control. Since full gene silencing by DNA methylation often takes multiple sexual generations, without wishing to be bound by theory, it is thought that further silencing of SUPERMAN will occur in selfed progeny of these plants.

Overall, the results suggest that SunTag DRM2-MTase lines containing 2 guides targeting SUPERMAN are able to successfully guide dCas9 to the SUPERMAN locus, and that DRM2-MTase is then able to induce methylation of SUPERMAN and gene silencing.

Example 17: Targeting of DNMT3A-3L to the FWA Locus Using the SunTag System

This Example demonstrates the targeting of the DNMT3A catalytic domain fused to the C-terminal domain of DNMT3L to the FWA locus using the SunTag system and the subsequent establishment of DNA methylation and silencing. Transforming *Arabidopsis* fwa epiallele plants with the SunTag construct led to methylation of the FWA promoter.

Materials and Methods

Materials and Methods used in this Example are similar to the Materials and Methods described in Example 9. One notable difference is that the DNMT3A-3L fusion is being used, as opposed to DRM2-MTase as described in Example 9. For targeting FWA, U6 driven sgRNA4 was used as described in Example 9.

The construct in this Example contained a DNMT3A-3L fusion. The catalytic methyltransferase domain of the DNMT3A protein and the C-terminal domain of the 3L protein were fused (DNMT3A-3L) and used to replace VP64 with a methylation effector. dCas9, single chain variable fragment (scFv) antibodies, and guide RNAs (gRNA) were cloned into a binary vector using In-Fusion cloning, which were then used for floral dipping in *Arabidopsis* thaliana.

The UBQ10 promoter preceding dCas9-GCN4×10 was followed by an Omega translational enhancer sequence. dCas9-GCN4×10 and scFv-GCN4-sfGFP-DNMT3A-3L-GB1-NLS cassettes were separated by a plant-specific TBS insulator sequence. gRNA expression was controlled by the Pol III specific U6 promoter and termination was controlled by the Pol III termination sequence.

The dCas9 expression cassette contained UBQ10_Omega RBC_dCas9_1×HA_NLSNLS_flexible linker_GCN4×10. The nucleotide sequence of this cassette is presented in SEQ ID NO: 854. The fusion protein encoded from this nucleotide sequence (dCas9_1×HA_NLSNLS_flexible linker_GCN4×10) is presented in SEQ ID NO: 855.

The scFv expression cassette contained UBQ10_scFv_sfGFP unique BsiWI site_glycine linker_DNMT3A (catalytic)-DNMT3L (C-terminal)_glycine linker_NLS_BsiWI site_GB1_REX NLS_NOS terminator. The nucleotide sequence of this cassette is presented in SEQ ID NO: 856. The fusion protein encoded from this nucleotide sequence (scFv_sfGFP_glycine linker_DNMT3A (catalytic)-DNMT3L (C-terminal)_glycine linker_NLS_GB1_REX NLS) is presented in SEQ ID NO: 857.

The gRNA was as follows: U6 promoter_protospacer #4_gRNA backbone_Pol III terminator. The nucleotide sequence of this gRNA is presented in SEQ ID NO: 858.

Results

Following confirmation that the SunTag DNMT3A-3L expression system components were being expressed and localized to the nucleus as described in Example 9, various plant lines were evaluated for whether this system could target DNMT3A-3L to FWA and induce methylation. Various T1 lines housing the SunTag DNMT3A-3L construct that contains sgRNA4 (which targets the promoter of FWA) were evaluated for methylation levels at FWA's promoter region.

Figure 45:
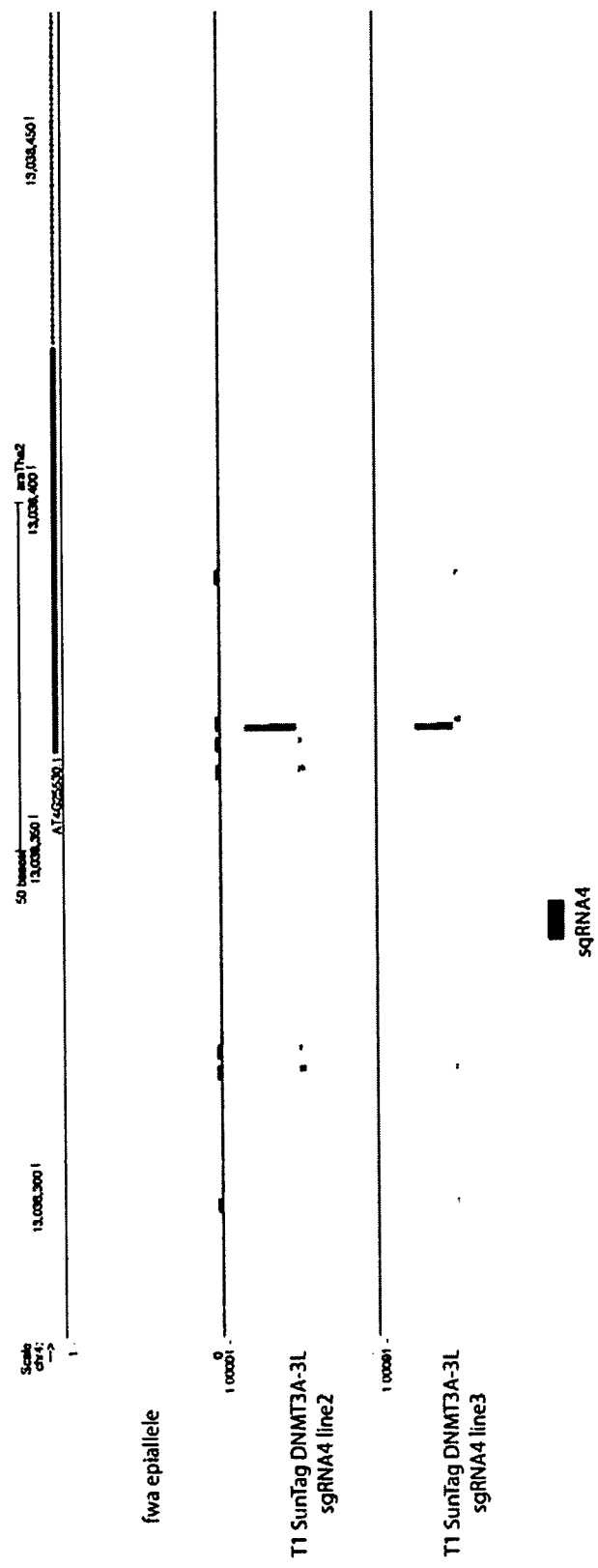
FIG. 45 illustrates whole-genome bisulfite sequencing data of T1 SunTag DNMT3A-3L *Arabidopsis thaliana* transgenic plants (fwa-4 background) with sgRNA #4 (g4) driven by the U6 promoter targeting FWA. Shown in the figure are CG methylation tracks of the fwa-4 control, and two early flowering lines: T1 SunTag DNMT3A-3L g4 line2 and T1 SunTag DNMT3A-3L g4 line3. Targeted methylation is present at the 5' end of the gene.

Multiple plants from multiple independent T1 SunTag DNMT3A-3L+sgRNA4 lines exhibited increased CG methylation at FWA's promoter region as compared to fwa epiallele controls plants. FIG. 45 shows examples of the increased CG methylation. In fwa-4, an epimutation results in loss of methylation from the FWA promoter. As shown in FIG. 45, there is no methylation present in the control, and the SunTag construct successfully introduces methylation at the targeted site. Two out of eight lines tested (the same two shown in FIG. 45), also exhibited a slightly early flowering phenotype, indicating partial silencing of FWA.

Overall, the results suggest that SunTag DNMT3A-3L lines containing sgRNA4 targeting FWA are able to successfully guide dCas9 to the FWA locus, and that DNMT3A-3L is then able to induce methylation of FWA. This methylation targeting was not as efficient as that seen in SunTag DRM2-MTase plants. Without wishing to be bound by theory, it is thought that increasing the number of gRNAs may increase the efficiency of methylation targeting by SunTag DNMT3A-3L.

Example 18: Additional Information

Transgenic T2 plants expressing the MS2-DRM2-MTase construct and different gRNAs targeting the FWA promoter (gRNA5, gRNA8 and gRNA3-gRNA14-gRNA17) (described in Example 3) were analyzed for flowering time, together with fwa-4 and Col0 controls. All the transgenic lines showed late flowering in T1 and T2 suggesting that these constructs were ineffective in causing FWA silencing. Methylation levels of different transgenic lines expressing dCas9 and MS2-MTase proteins were analyzed by whole genome bisulfite sequencing. Results showed no methylation at the FWA promoter.

T1 and T2 transgenic plants expressing straight fusions of dCas9 to DMS3 or DRM2-MTase together with gRNAs targeting the FWA promoter (described in Example 1), were analyzed for flowering time and DNA methylation by whole genome bisulfite sequencing. None of the lines showed early flowering or DNA methylation at the FWA promoter suggesting that these constructs were not effective in causing silencing or DNA methylation.

A fragment containing hdSpdCas9 fused to DNMT3A and DNMT3L was amplified from the hdSpCas9-3a3-3×Flag plasmid (Albert Jeltsch's lab) and cloned into a modified pMDC123 plasmid between the *Arabidopsis* UBQ10 promoter and the NOS terminator. Two gRNAs cassettes, each containing a U6 promoter and a gRNA targeting the FWA promoter were cloned in tandem upstream of the UBQ10 promoter. The resulting plasmid was introduced into *agrobacterium* and fwa-4 plants were transformed by the floral dip method. Transgenic plants were scored for expression of the transgene and flowering time together with fwa-4 and Col0 controls. All the lines expressing the transgene were late flowering. Methylation of two independent T1 plants expressing the transgene was analyzed by whole-genome bisulfite sequencing. Results showed no methylation at FWA promoter. These results suggest that these constructs were ineffective in triggering silencing and methylation of FWA.

A CG-specific methyltransferase from *Mycoplasma penetrans* (MpeI) was plant-codon optimized and gene synthesized (IDT technologies). The resulting fragment was cloned into a modified pMDC123 plasmid downstream of a cassette containing UBQ10 promoter, ZF108 and 3×Flag. The resulting plasmid was transformed into *Agrobacterium* and introduced into fwa-4 plants by the floral dip method. 47 transgenic T1 plants were analyzed for flowering time and all showed a late flowering phenotype, indicating that this construct was not effective in inducing gene silencing.

REFERENCES

Law, J. A. & Jacobsen, S. E. Establishing, maintaining and modifying DNA methylation patterns in plants and animals. Nat Rev Genet 11, 204-220 (2010).

Haag, J. R. & Pikaard, C. S. Multisubunit RNA polymerases IV and V: purveyors of non-coding RNA for plant gene silencing. Nat Rev Mol Cell Biol 12, 483-492, doi: 10.1038/nrm3152 (2011).

Law, J. A., Vashisht, A. A., Wohlschlegel, J. A. & Jacobsen, S. E. SHH1, a Homeodomain Protein Required for DNA Methylation, As Well As RDR2, RDM4, and Chromatin Remodeling Factors, Associate with RNA Polymerase IV. PLoS Genet 7, e1002195, doi:10.1371/journal.pgen.1002195 (2011).

Liu, J. et al. An atypical component of RNA-directed DNA methylation machinery has both DNA methylation-dependent and -independent roles in locus-specific transcriptional gene silencing. Cell Res 21, 1691-1700, doi: 10.1038/cr.2011.173 (2011).

Olovnikov, I., Aravin, A. A. & Fejes Toth, K. Small RNA in the nucleus: the RNA-chromatin ping-pong. Curr Opin Genet Dev 22, 164-171, doi:10.1016/j.gde.2012.01.002 (2012).

Mosher, R. A., Schwach, F., Studholme, D. & Baulcombe, D. C. PolIVb influences RNA-directed DNA methylation independently of its role in siRNA biogenesis. Proc Natl Acad Sci USA 105, 3145-3150 (2008).

Zhang, X., Henderson, I. R., Lu, C., Green, P. J. & Jacobsen, S. E. Role of RNA polymerase IV in plant small RNA metabolism. Proc Natl Acad Sci USA 104, 4536-4541 (2007).

Cokus, S. J. et al. Shotgun bisulphite sequencing of the *Arabidopsis* genome reveals DNA methylation patterning. Nature 452, 215-219 (2008).

Cao, X. et al. Role of the DRM and CMT3 methyltransferases in RNA-directed DNA methylation. Curr Biol 13, 2212-2217 (2003).

Du, J. et al. Dual Binding of Chromomethylase Domains to H3K9me2-containing Nucleosomes Directs DNA Methylation in Plants. Cell Accepted (2012).

Zhong, X. et al. DDR complex facilitates global association of RNA polymerase V to promoters and evolutionarily young transposons. Nat Struct Mol Biol, doi:10.1038/nsmb.2354 (2012).

Mukherjee, K., Brocchieri, L. & Burglin, T. R. A comprehensive classification and evolutionary analysis of plant homeobox genes. Mol Biol Evol 26, 2775-2794 (2009).

Cedar, H. & Bergman, Y. Linking DNA methylation and histone modification: patterns and paradigms. Nat Rev Genet 10, 295-304 (2009).

Zhang, X., Bernatavichute, Y. V., Cokus, S., Pellegrini, M. & Jacobsen, S. E. Genome-wide analysis of mono-, di- and trimethylation of histone H3 lysine 4 in *Arabidopsis thaliana*. Genome Biol 10, R62 (2009).

Bian, C. et al. Sgf29 binds histone H3K4me2/3 and is required for SAGA complex recruitment and histone H3 acetylation. EMBO J 30, 2829-2842, doi:10.1038/emboj.2011.193 (2011).

Holm, L. & Rosenstrom, P. Dali server: conservation mapping in 3D. Nucleic Acids Res 38, W545-549, doi: 10.1093/nar/gkq366 (2010).

Nady, N. et al. Recognition of multivalent histone states associated with heterochromatin by UHRF1 protein. Journal of Biological Chemistry 286, 24300-24311, doi: 10.1074/jbc.M111.234104 (2011).

Bernatavichute, Y. V., Zhang, X., Cokus, S., Pellegrini, M. & Jacobsen, S. E. Genome-wide association of histone H3 lysine nine methylation with CHG DNA methylation in *Arabidopsis thaliana*. PLoS ONE 3, e3156 (2008).

Taverna, S. D., Li, H., Ruthenburg, A. J., Allis, C. D. & Patel, D. J. How chromatin-binding modules interpret histone modifications: lessons from professional pocket pickers. Nat Struct Mol Biol 14, 1025-1040, doi:10.1038/nsmb1338 (2007).

Zhang, X. et al. Genome-wide high-resolution mapping and functional analysis of DNA methylation in *Arabidopsis*. Cell 126, 1189-1201 (2006).

Zilberman, D. et al. Role of *Arabidopsis* ARGONAUTE4 in RNA-directed DNA methylation triggered by inverted repeats. Curr Biol 14, 1214-1220 (2004).

Xie, Z. et al. Genetic and functional diversification of small RNA pathways in plants. PLoS Biol 2, E104 (2004).

Li, C. F. et al. An ARGONAUTE4-containing nuclear processing center colocalized with Cajal bodies in *Arabidopsis thaliana*. Cell 126, 93-106 (2006).

Pontes, O. et al. The *Arabidopsis* chromatin-modifying nuclear siRNA pathway involves a nucleolar RNA processing center. Cell 126, 79-92 (2006).

Zilberman, D., Cao, X. & Jacobsen, S. E. ARGONAUTE4 control of locus-specific siRNA accumulation and DNA and histone methylation. Science 299, 716-719 (2003).

Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., et al. (2010). PHENIX: a comprehensive Python-based system for macromolecular structure solution. Acta crystallographica Section D, Biological crystallography 66, 213-221.

Arita, K., Ariyoshi, M., Tochio, H., Nakamura, Y., and Shirakawa, M. (2008). Recognition of hemi-methylated DNA by the SRA protein UHRF1 by a base-flipping mechanism. Nature 455, 818-821.

Aufsatz, W., Mette, M. F., van der Winden, J., Matzke, A. J., and Matzke, M. (2002). RNA-directed DNA methylation in *Arabidopsis*. Proceedings of the National Academy of Sciences of the United States of America 99 Suppl 4, 16499-16506.

Aufsatz, W., Mette, M. F., Matzke, A. J. & Matzke, M. The role of MET1 in RNA-directed de novo and maintenance methylation of CG dinucleotides. *Plant Molecular Biology* 54, 793-804 (2004).

Avvakumov, G. V., Walker, J. R., Xue, S., Li, Y., Duan, S., Bronner, C., Arrowsmith, C. H., and Dhe-Paganon, S. (2008). Structural basis for recognition of hemi-methylated DNA by the SRA domain of human UHRF1. Nature 455, 822-825.

Bernatavichute, Y. V., Zhang, X., Cokus, S., Pellegrini, M., and Jacobsen, S. E. (2008). Genome-wide association of histone H3 lysine nine methylation with CHG DNA methylation in *Arabidopsis thaliana*. PloS one 3, e3156.

Black, J. C., Van Rechem, C., and Whetstine, J. R. (2012). Histone lysine methylation dynamics: establishment, regulation, and biological impact. Molecular cell 48, 491-507.

Bostick, M., Kim, J. K., Esteve, P. O., Clark, A., Pradhan, S., and Jacobsen, S. E. (2007). UHRF1 plays a role in maintaining DNA methylation in mammalian cells. Science 317, 1760-1764.

Brzeski, J., and Jerzmanowski, A. (2003). Deficient in DNA methylation 1 (DDM1) defines a novel family of chromatin-remodeling factors. The Journal of biological chemistry 278, 823-828.

Cao, X., and Jacobsen, S. E. (2002). Role of the *Arabidopsis* DRM methyltransferases in de novo DNA methylation and gene silencing. Current biology: CB 12, 1138-1144.

Chan, S. W., Zhang, X., Bernatavichute, Y. V., and Jacobsen, S. E. (2006). Two-step recruitment of RNA-directed DNA methylation to tandem repeats. PLoS biology 4, e363.

Du, J., Zhong, X., Bernatavichute, Y. V., Stroud, H., Feng, S., Caro, E., Vashisht, A. A., Terragni, J., Chin, H. G., Tu, A., et al. (2012). Dual Binding of Chromomethylase Domains to H3K9me2-Containing Nucleosomes Directs DNA Methylation in Plants. Cell 151, 167-180.

Ebbs, M. L., and Bender, J. (2006). Locus-specific control of DNA methylation by the *Arabidopsis* SUVH5 histone methyltransferase. The Plant cell 18, 1166-1176.

El-Shami, M., Pontier, D., Lahmy, S., Braun, L., Picart, C., Vega, D., Hakimi, M. A., Jacobsen, S. E., Cooke, R., and Lagrange, T. (2007). Reiterated WG/GW motifs form functionally and evolutionarily conserved ARGONAUTE-binding platforms in RNAi-related components. Genes & development 21, 2539-2544.

Emsley, P., Lohkamp, B., Scott, W. G., and Cowtan, K. (2010). Features and development of Coot. Acta crystallographica Section D, Biological crystallography 66, 486-501.

Feng, S., Rubbi, L., Jacobsen, S. E., and Pellegrini, P. (2011). Determining DNA Methylation Profiles Using Sequencing. Methods in Molecular Biology 733, 223-238.

Finnegan, E. J., and Dennis, E. S. (1993). Isolation and identification by sequence homology of a putative cytosine methyltransferase from *Arabidopsis thaliana*. Nucleic acids research 21, 2383-2388.

Gouet, P., Courcelle, E., Stuart, D. I., and Metoz, F. (1999). ESPript: analysis of multiple sequence alignments in PostScript. Bioinformatics 15, 305-308.

Greenberg, M. V., Ausin, I., Chan, S. W., Cokus, S. J., Cuperus, J. T., Feng, S., Law, J. A., Chu, C., Pellegrini, M., Carrington, J. C., et al. (2011). Identification of genes required for de novo DNA methylation in *Arabidopsis*. Epigenetics: official journal of the DNA Methylation Society 6, 344-354.

Hashimoto, H., Horton, J. R., Zhang, X., Bostick, M., Jacobsen, S. E., and Cheng, X. (2008). The SRA domain of UHRF1 flips 5-methylcytosine out of the DNA helix. Nature 455, 826-829.

Jackson, J. P., Lindroth, A. M., Cao, X., and Jacobsen, S. E. (2002). Control of CpNpG DNA methylation by the KRYPTONITE histone H3 methyltransferase. Nature 416, 556-560.

Johnson, L. M., Bostick, M., Zhang, X., Kraft, E., Henderson, I., Callis, J., and Jacobsen, S. E. (2007). The SRA methyl-cytosine-binding domain links DNA and histone methylation. Current biology: CB 17, 379-384.

Johnson, L. M., Law, J. A., Khattar, A., Henderson, I. R., and Jacobsen, S. E. (2008). SRA-domain proteins required for DRM2-mediated de novo DNA methylation. PLoS genetics 4, e1000280.

Jones, P. A. (2012). Functions of DNA methylation: islands, start sites, gene bodies and beyond. Nature reviews Genetics 13, 484-492.

Kakutani, T. (1997). Genetic characterization of late-flowering traits induced by DNA hypomethylation mutation in *Arabidopsis thaliana*. The Plant journal: for cell and molecular biology 12, 1447-1451.

Kinoshita, Y., Saze, H., Kinoshita, T., Miura, A., Soppe, W. J., Koornneef, M., and Kakutani, T. (2007). Control of FWA gene silencing in *Arabidopsis thaliana* by SINE-related direct repeats. The Plant journal: for cell and molecular biology 49, 38-45.

Kolb, A. F., Coates, C. J., Kaminski, J. M., Summers, J. B., Miller, A. D., and Segal, D. J. (2005). Site-directed genome modification: nucleic acid and protein modules for targeted integration and gene correction. Trends in biotechnology 23, 399-406.

Kuhlmann, M., and Mette, M. F. (2012). Developmentally non-redundant SET domain proteins SUVH2 and SUVH9 are required for transcriptional gene silencing in *Arabidopsis thaliana*. Plant molecular biology. Larkin, M. A., Blackshields, G., Brown, N. P., Chenna, R., McGettigan, P. A., McWilliam, H., Valentin, F., Wallace, I. M., Wilm, A., Lopez, R., et al. (2007). Clustal W and Clustal X version 2.0. Bioinformatics 23, 2947-2948.

Laskowski, R. A., Macarthur, M. W., Moss, D. S., and Thornton, J. M. (1993). PROCHECK: a program to check the stereochemical quality of protein structures. J Appl Crystallogr 26, 283-291.

Law, J. A., Ausin, I., Johnson, L. M., Vashisht, A. A., Zhu, J. K., Wohlschlegel, J. A., and Jacobsen, S. E. (2010). A protein complex required for polymerase V transcripts and RNA-directed DNA methylation in *Arabidopsis*. Current biology: CB 20, 951-956.

Law, J. A., and Jacobsen, S. E. (2010). Establishing, maintaining and modifying DNA methylation patterns in plants and animals. Nature reviews Genetics 11, 204-220.

Lindroth, A. M., Cao, X., Jackson, J. P., Zilberman, D., McCallum, C. M., Henikoff, S., and Jacobsen, S. E. (2001). Requirement of CHROMOMETHYLASE3 for maintenance of CpXpG methylation. Science 292, 2077-2080.

Lindroth, A. M., Shultis, D., Jasencakova, Z., Fuchs, J., Johnson, L., Schubert, D., Patnaik, D., Pradhan, S., Goodrich, J., Schubert, I., et al. (2004). Dual histone H3 methylation marks at lysines 9 and 27 required for interaction with CHROMOMETHYLASE3. The EMBO journal 23, 4286-4296.

Lister, R. et al. Highly integrated single-base resolution maps of the epigenome in *Arabidopsis*. Cell 133, 523-536 (2008).

Malagnac, F., Bartee, L., and Bender, J. (2002). An *Arabidopsis* SET domain protein required for maintenance but not establishment of DNA methylation. The EMBO journal 21, 6842-6852.

Otwinowski, Z., and Minor, W. (1997). Processing of X-ray diffraction data collected in oscillation mode. Methods Enzymol 276, 307-326.

Pelissier, T., and Wassenegger, M. (2000). A DNA target of 30 bp is sufficient for RNA-directed DNA methylation. RNA 6, 55-65.

Pikaard, C. S., Haag, J. R., Ream, T., and Wierzbicki, A. T. (2008). Roles of RNA polymerase IV in gene silencing. Trends in plant science 13, 390-397.

Pontier, D., Yahubyan, G., Vega, D., Bulski, A., Saez-Vasquez, J., Hakimi, M. A., Lerbs-Mache, S., Colot, V., and Lagrange, T. (2005). Reinforcement of silencing at transposons and highly repeated sequences requires the concerted action of two distinct RNA polymerases IV in *Arabidopsis*. Genes & development 19, 2030-2040.

Rajakumara, E., Law, J. A., Simanshu, D. K., Voigt, P., Johnson, L. M., Reinberg, D., Patel, D. J., and Jacobsen, S. E. (2011). A dual flip-out mechanism for 5 mC recognition by the *Arabidopsis* SUVH5 SRA domain and its impact on DNA methylation and H3K9 dimethylation in vivo. Genes & development 25, 137-152.

Rincon-Arano, H., Halow, J., Delrow, J. J., Parkhurst, S. M., and Groudine, M. (2012). UpSET Recruits HDAC Complexes and Restricts Chromatin Accessibility and Acetylation at Promoter Regions. Cell 151, 1214-1228.

Segal, D. J., Beerli, R. R., Blancafort, P., Dreier, B., Effertz, K., Huber, A., Koksch, B., Lund, C. V., Magnenat, L., Valente, D., et al. (2003). Evaluation of a modular strategy for the construction of novel polydactyl zinc finger DNA-binding proteins. Biochemistry 42, 2137-2148.

Smith, E., and Shilatifard, A. (2010). The chromatin signaling pathway: diverse mechanisms of recruitment of histone-modifying enzymes and varied biological outcomes. Molecular cell 40, 689-701.

Soppe, W. J., Jacobsen, S. E., Alonso-Blanco, C., Jackson, J. P., Kakutani, T., Koornneef, M., and Peeters, A. J. (2000). The late flowering phenotype of fwa mutants is caused by gain-of-function epigenetic alleles of a homeodomain gene. Molecular cell 6, 791-802.

Springer, N. M., Napoli, C. A., Selinger, D. A., Pandey, R., Cone, K. C., Chandler, V. L., Kaeppler, H. F., and Kaeppler, S. M. (2003). Comparative analysis of SET domain proteins in maize and *Arabidopsis* reveals multiple duplications preceding the divergence of monocots and dicots. Plant physiology 132, 907-925.

Stroud, H., Greenberg, M. V., Feng, S., Bernatavichute, Y. V., and Jacobsen, S. E. (2013). Comprehensive analysis of silencing mutants reveals complex regulation of the *Arabidopsis* methylome. Cell 152, 352-364.

Wierzbicki, A. T., Haag, J. R., and Pikaard, C. S. (2008). Noncoding transcription by RNA polymerase Pol IVb/Pol V mediates transcriptional silencing of overlapping and adjacent genes. Cell 135, 635-648.

Wierzbicki, A. T., Ream, T. S., Haag, J. R., and Pikaard, C. S. (2009). RNA polymerase V transcription guides ARGONAUTE4 to chromatin. Nature genetics 41, 630-634.

Woo, H. R., Dittmer, T. A., and Richards, E. J. (2008). Three SRA-domain methylcytosine-binding proteins cooperate to maintain global CpG methylation and epigenetic silencing in *Arabidopsis*. PLoS genetics 4, e1000156.

Wu, H., Min, J., Lunin, V. V., Antoshenko, T., Dombrovski, L., Zeng, H., Allali-Hassani, A., Campagna-Slater, V., Vedadi, M., Arrowsmith, C. H., et al. (2010). Structural biology of human H3K9 methyltransferases. PLoS one 5, e8570.

Zhang, X., Tamaru, H., Khan, SI., Horton, JR., Keefe, L. J., Selker, E. U., and Cheng, X. (2002). Structure of the *Neurospora* SET domain protein DIM-5, a histone H3 lysine methyltransferase. Cell 111, 117-127.

Zhang, X., Yang, Z., Khan, S. I., Horton, JR., Tamaru, H., Selker, E. U., and Cheng, X. (2003). Structural basis for the product specificity of histone lysine methyltransferases. Molecular cell 12, 177-185.

Zhong, X., Hale, C. J., Law, J. A., Johnson, L. M., Feng, S., Tu, A., and Jacobsen, S. E. (2012). DDR complex facilitates global association of RNA polymerase V to promoters and evolutionarily young transposons. Nature structural & molecular biology.

Jinek M, et al. (2012) A programmable dual-RNA-guided DNA endonuclease in adaptive bacterial immunity. *Science* 337(6096):816-821.

Gilbert L A, et al. (2013) CRISPR-mediated modular RNA-guided regulation of transcription in eukaryotes. Cell 154(2):442-451.

Friedland A E, et al. (2013) Heritable genome editing in *C. elegans* via a CRISPR-CAS9 system. *Nat Methods* 10(8): 741-743.

Bassett A R, Tibbit C, Ponting C P, & Liu J L (2013) Highly efficient targeted mutagenesis of *Drosophila* with the CRISPR-CAS9 system. *Cell Rep* 4(1):220-228.

Yang H, et al. (2013) One-step generation of mice carrying reporter and conditional alleles by CRISPR/Cas-mediated genome engineering. *Cell* 154(6):1370-1379.

Cong L, et al. (2013) Multiplex genome engineering using CRISPR/Cas systems. *Science* 339(6121):819-823.

Jiang W, et al. (2013) Demonstration of CRISPR-CAS9/sgRNA-mediated targeted gene modification in *Arabidopsis*, tobacco, sorghum and rice. *Nucleic Acids Res* 41(20):e188.

Feng Z, et al. (2013) Efficient genome editing in plants using a CRISPR/Cas system. *Cell Res* 23(10):1229-1232.

Li J F, et al. (2013) Multiplex and homologous recombination-mediated genome editing in *Arabidopsis* and *Nicotiana benthamiana* using guide RNA and CAS9. *Nature biotechnology* 31(8):688-691.

Sugano S S, et al. (2014) CRISPR-CAS9 Mediated Targeted Mutagenesis in the Liverwort Marchantia *polymorpha* L. *Plant & cell physiology*.

Upadhyay S K, Kumar J, Alok A, & Tuli R (2013) RNA-Guided Genome Editing for Target Gene Mutations in Wheat. G3 (Bethesda, Md.) 3(12):2233-2238.

Puchta H & Fauser F (2013) Synthetic nucleases for genome engineering in plants: prospects for a bright future. *The Plant journal: for cell and molecular biology*.

Belhaj K, Chaparro-Garcia A, Kamoun S, & Nekrasov V (2013) Plant genome editing made easy: targeted mutagenesis in model and crop plants using the CRISPR/Cas system. *Plant methods* 9(1):39.

Miao J, et al. (2013) Targeted mutagenesis in rice using CRISPR-Cas system. *Cell Res* 23(10):1233-1236.

Mao Y, et al. (2013) Application of the CRISPR-Cas system for efficient genome engineering in plants. *Molecular plant* 6(6):2008-2011.

Xie K & Yang Y (2013) RNA-guided genome editing in plants using a CRISPR-Cas system. *Molecular plant* 6(6):1975-1983.

Shan Q, et al. (2013) Targeted genome modification of crop plants using a CRISPR-Cas system. *Nature biotechnology* 31(8):686-688.

Wiedenheft B, Sternberg S H, & Doudna J A (2012) RNA-guided genetic silencing systems in bacteria and archaea. *Nature* 482(7385):331-338.

Deltcheva E, et al. (2011) CRISPR RNA maturation by trans-encoded small RNA and host factor RNase III. *Nature* 471(7340):602-607.

Qi L S, et al. (2013) Repurposing CRISPR as an RNA-guided platform for sequence-specific control of gene expression. *Cell* 152(5):1173-1183.

Mali P, et al. (2013) CAS9 transcriptional activators for target specificity screening and paired nickases for cooperative genome engineering. *Nature biotechnology* 31(9): 833-838.

Genetic Engineering and Chemical Conjugation of Potato Virus X Methods in Molecular Biology Volume 1108, 2014, pp 3-21.

Flexibility between the protease and helicase domains of the dengue virus NS3 protein conferred by the linker region and its functional implications. J Biol Chem. 2010 Jun. 11; 285(24):18817-27.

BglBricks: A flexible standard for biological part assembly J Biol Eng. 2010 Jan. 20; 4(1):1. doi: 10.1186/1754-1611-4-1.

Engineering peptide linkers for scFv immunosensors Anal Chem. 2008 Mar. 15; 80(6):1910-7. doi: 10.1021/ac7018624. Epub 2008 February 22.

Chen et al., Fusion protein linkers: Property, design and functionality. Volume 65, Issue 10, 15 Oct. 2013, Pages 1357-1369.

Mali et al., Cas9 as a versatile tool for engineering biology. Nature Methods, 2013.

Hartoon Baazim Thesis, "RNA-guided Transcriptional Regulation in Plants via dCas9 Chimeric Proteins." King Abdullah University of Science and Technology. Thuwal, Kingdom of Saudi Arabia. May, 2014

Swiech et al. In vivo interrogation of gene function in the mammalian brain using CRISPR-CAS9. Nature Biotechnology, Vol 33, Number 1. January 2015.

Wu et al. Genome-wide binding of the CRISPR endonuclease Cas9 in mammalian cells. Nature Biotechnology, Vol 32, Number 7. July 2014.

Esvelt et al. Orthogonal Cas9 proteins for RNA-guided gene regulation and editing. Nature Methods. November 2013.

Zalatan et al. Engineering Complex Synthetic Transcriptional Programs with CRISPR RNA Scaffolds. Cell 160, 339-350, Jan. 15, 2015.

Konermann et al. Genome-scale transcriptional activation by an engineered CRISPR-CAS9 complex. Nature, Vol 517, page 583. Jan. 29, 2015.

Jinek et al. A Programmable Dual-RNA-Guided DNA Endonuclease in Adaptive Bacterial Immunity. Science, Vol 337. Aug. 17, 2012.

van der Oost et al. Unravelling the structural and mechanistic basis of CRISPR-Cas systems. Nature Reviews, Volume 12. July 2014.

Gilbert et al. Genome-Scale CRISPR-Mediated Control of Gene Repression and Activation. Cell 159, 647-661, Oct. 23, 2014.

Tanenbaum et al. A Protein-Tagging System for Signal Amplification in Gene Expression and Fluorescence Imaging. Cell 159, 635-646, Oct. 23, 2014.

Binz et al., 2004, High-affinity binders selected from designed ankyrin repeat protein libraries. Nat. Biotechnol. 22, 575-582.

Xie, X et al, Boosting CRISPR/Cas9 multiplex editing capability with the endogenous tRNA-processing system. 2015, Proc Natl Acad Sci USA. 2015 March 17; 112(11): 3570-5

Johnson et al (2008), SRA-Domain Proteins Required for DRM2-Mediated De Novo DNA Methylation. PLoS Genet 4(11): e1000280. doi:10.1371/journal.pgen.1000280

Kang H G, Klessig D F. The involvement of the *Arabidopsis* CRT1 ATPase family in disease resistance protein-mediated signaling. Plant Signal Behav. 2008; 3(9):689-690

Kang H G, Kuhl J C, Kachroo P, Klessig D F. CRT1, an *Arabidopsis* ATPase that interacts with diverse resistance proteins and modulates disease resistance to turnip crinkle virus. Cell Host Microbe. 2008; 3(1):48-57.

Kang H G1, Oh C S, Sato M, Katagiri F, Glazebrook J, Takahashi H, Kachroo P, Martin G B, Klessig D F. Endosome-associated CRT1 functions early in resistance gene-mediated defense signaling in *Arabidopsis* and tobacco. Plant Cell. 2010; 22(3):918-936.

Kang H G1, Hyong W C, von Einem S, Manosalva P, Ehlers K, Liu P P, Buxa S V, Moreau M, Mang H G, Kachroo P, Kogel K H, Klessig D F.. CRT1 is a nuclear-translocated MORC endonuclease that participates in multiple levels of plant immunity. Nat Commun. 2012; 3:1297.

Moissiard G, et al. MORC family ATPases required for heterochromatin condensation and gene silencing. Science. 2012; 336(6087):1448-1451.

Moissiard G, Bischof S, Husmann D, Pastor W A, Hale C J, Yen L, Stroud H, Papikian A, Vashisht A A, Wohlschlegel J A, Jacobsen S E.

Transcriptional gene silencing by *Arabidopsis microrchidia* homologues involves the formation of heteromers. Proc Natl Acad Sci USA. 2014 May 20; 111(20):7474-9. doi: 10.1073/pnas.1406611111.

Liu Z W, Shao C R, Zhang C J, Zhou J X, Zhang S W, Li L, Chen S, Huang H W, Cai T, He X J. The SET domain proteins SUVH2 and SUVH9 are required for Pol V occupancy at RNA-directed DNA methylation loci. PLoS Genet. 2014 January; 10(1):e1003948. doi: 10.1371/journal.pgen.1003948.

Segal E, et al. (2003) Module networks: identifying regulatory modules and their condition-specific regulators from gene expression data. *Nat Genet* 34(2):166-176.

Kolb A F, et al. (2005) Site-directed genome modification: nucleic acid and protein modules for targeted integration and gene correction. *Trends in biotechnology* 23(8):399-406.

Johnson L M, et al. (2014) SRA- and SET-domain-containing proteins link RNA polymerase V occupancy to DNA methylation. *Nature* 507(7490):124-128.

Hume Stroud, Bo Ding, Stacey A Simon, Suhua Feng, Maria Bellizzi, Matteo Pellegrini, Guo-Liang Wang, Blake C Meyers, Steven E Jacobsen. (2013) Plants regenerated from tissue culture contain stable epigenome changes in rice. *eLife*, 2:e00354. DOI: 10.7554/eLife.00354.

SEQUENCE LISTING (915 sequences)

SEQ ID NO: 1 - protein, 258 aa, Arabidopsis thaliana
MAASDDSSHYFTEFTLSEIVDMENLYKELGDQSLHKDFCQTVASTFSCSVNRNGKSSITWKQVQIWFQEKLKHQSQPKSKTLPSPPLQIHDLSNPSSYASNASNATFVGNSTFVQTRKGKASDLADLAFEAKSARDYAWYDVSSFLTYRVLRTGELEVRVRFSGFDNRHDEWVNVKTSVRERSIPVEPSECGRVNVGDLLLCFQEREDQALYCDGHVLNIKRGIHDHARCNCVFLVRYELDNTEESLGLERICRRPEE

SEQ ID NO: 2 - protein, 285 aa, Ricinus communis
MTASHELGGHRRPHTRETLETSLTTTQNPVNIAKQKAQSLFWLVMGSPSEFTLAEMVEMENIYKELGEESLDSEFCERLATSFSFTANRAGKPAITWEQVQSWFEDRQKESRPRVSPSPLSLKLFVDLSNAKISSDAPESSRNSKGKVTDLSELIFEARSSRDNAWYDVAAFLNYRVLSTGELEARVRFSGFRNTDDEWVNVKRAVRERSIPLEPSECHRVKVGDLVLCFRERFDQAVYCDAHVVGIQRRPHEAASCRCIFVVRYDHDNTEEAAQLERLCCRPTQ

SEQ ID NO: 3 - protein, 273 aa, Glycine max
MEKLPLTEYPFPKLSLDEILELERIYKDVVGKVFNRKLCQEIAKRFSSSSNGAGKNSLSWQQVQLWFRNSQRMLLGEDISSSDLLKISADLADSPLLGNGKGKQATDLDDMGFEARSTKDNAWHDVSMFLNYRVLSTGELEVRVRYAGFGKEQDEWMNVKLGVRERSIPLEPSECHKVKDGDLVLCFLEKEDYALYCDARIVKIQRKIHDPTDCTCTFIVQFVHDNTEEGVSFSRICCRPTQEESACFPDLALDPTQSPSLNFPLNTIESLWG

SEQ ID NO: 4 - protein, 381 aa, Zea mays
MGRPPSTTGAPAFRFLPSEVAEMEARLLQLNNGIPTRAMLQTLADKFSASPERAGKVAIQPKQVWNWFQNRRYSHRAKTTRVVPSPPAKMPSGADHHQHAANASAFRAAQPSSVAVAHHGSSSTGKNPMEGVSVEFEAKSARDGAWYDVAAFLSHRLFESGDPEVRVRFSGFGAEEDEWINVRKCVRQRSLPCEATECVAVLPGDLILCFQEDKEQALYFDARVLDAQRRRHDVRGCRCRFLVRYDHDSSEEIVPLRKVCRRPETDYRLQILHAARAAAASADIHTPPREAKVELASNAKSPYEQKPQKQYKMMDVNTDEEVTMVSTLEQDETQGKTVAPVPSATAETRNSSSDAVMKDAEASSVAQDDDEVQVVDKMKEG

SEQ ID NO: 5 - protein, 270 aa, Medicago truncatula
MKELTSNESPFPKLSLDEILELERIYNDVGEKSLDPNFCKDIAANFSSSSNSDGKTSLTWEQVQQWLQNKHTETKGHFASSPEGLNLVVDLSGKSSSIKGNKSSPKPKGIQAADLSELAFEAVSIKDNAWHDVSMFLNYRVLCTGELEVRVRYHGFGKDEDEWINVKYGVRQRSIPLEASECHKVKEGHLVLCFHVKSDYALYCDAIVLKIQRREHDSEECSCIFTVRFYHDKFEEEVRWDSLCCRPTQEESEVPFELEPTMNPIANLWG

SEQ ID NO: 6 - protein, 274 aa, Physcomitrella patens
MGRTPMSGGTAFRFLPAEVADMEKALDASNGATPARSIVETLADKFTNSSERSGQRPVQWKQQVWNWFQNRRHAQKAKIDKLKGVGPGGETPSAAKSVVIMLVTVRLCILVDRVNVITGAAKKPNVHVPMDFEAKSARDGAWYVYDVSAFINKRTGENGEPEVRVRFAGFGSEEDEWVNIATAVRQRSLPCETTECVAVLPGDLILCFQEGSEQALYFDADILDVQRRRHDVRGCRCRFWVRYRHDQTEVEVVPLRKVCRRPETEQRLQQAREA

SEQ ID NO: 7 - protein, 381 aa, Sorghum bicolor
MGRPPSTTGAPAFRFLPSEVAEMEARLQQLNNGIPSRGVLQTLADKFSASPERAGKVAIQPKQVWNWFQNRRYSHRAKSTRAVPSPPAKMTPSGADHHQHAANASAFRAAQPSSVAAAHHGASPTGKNPVEGVSVEFEAKSARDGAWYDVAAFLSQRLFETGEPEVRVRFSGFGAEEDEWINVRKCVRQRSLPCEATECVAVLPGDLILCFQEGKEQALYFDARVLDAQRRRHDVRGCRCRFLVRYDHDSSEEIVPLRKVCRRPDTDYRLQILHAARVAATNADIHTPPKEIKVELTSNDKSPTEQKPQKQHKMMDVNTDEVTMVSTLEQDETQGKTVAPLPSSTVETRNSSSDAVMKDAEASSVVEDDDEVQVVDKMKEG

SEQ ID NO: 8 - protein, 269 aa, Oryza sativa
MERRSSVRFAPSEIARMEKLVTHKKEQVLDEIFCRKLAEEFNCSPGRVGSKALQAVQVQEWFRQKFPASTVIPPCLPTGSEEKALASQASAPVSEEKPPSSEENALAVDTSISNDIGEVSPDLPIDNIDKLPEIEDMQFEARSSKDFAWYDIATFLAYRKLSSGEFEVRVRFQGFGAEEDEWINVRKAIRLQSIPLESSECKLIREGDLVLCFKESNDEALHFDAHVLEIQRKQHDIRGCRCVFLVEYDHDGTQERVNLRRLSRRPKHS

SEQ ID NO: 9 - protein, 360 aa, Brachypodium distachyon
MGRPPSSGGPAFRFTHAEVAEMEEHLRHLNNAIPHRDVIQGLADKFTASPARAGKISVQPKQVWNWFQNRRYSQRNRTTRGAPLPQGKMLPTGAADEHHSASFGAQSASSVYPTGKNSSNGGQVDFEAKSARDGAWYDVAHFLSHRLFETGEPEVRVRFSGFGAEEDEWINVRKCVRQRSLPCEPTECVAVLPGDLILCFQEGKEQALYFDARILDAQRRRHDVRGCRCRFLVRYDHDHSEEIVPLRKVCRRPDNGFRQHILHANRVAASAQDVHMGIQIDRSSAEQKPQKPHKMMDVNTDEVTMVPKVEPTDKPVVSLPAASISTRGDSSSDVTMKDAGATPEVEAADEGQGDKMNAGE

SEQ ID NO: 10 - protein, 239 aa, Populus trichocarpa
MDFEFTLSEMLEMENMFKELEEGPLAPQFCEKLASSFSLAPSRDGKQAITPRQVKSWFQDRLKKSQPRVASSNMALKLFADLSDASASFGATESSQKLKGNASDLSELIFEALSSKDNAWYDVASFLNYRVVCSGELEVRVRFAGFRNTDDEWVNVRRAVRERSIPLESSECQRVKVGDLVLCFQEREERAVYCDAHIVEINRKLHDINGCRCTFVVRYDHDDFEEEVRLDRLCGRPTP

SEQ ID NO: 11 - protein, 247 aa, Vitis vinifera
MDDAPVPIACFTQSEILEMENLFEEFGEETLGQEFCQDLATSFSASPGCSGNMPVGWKEVRDWFQTKQKELVARVTSSPVAPRGIDALPEAPMSNNAPQNSIVPRGDMVAADLSELTYEAKSSKDDAWYDVAAFLTYRVLSSGELEARVRFSGFGNEEDEWVNVKKGIRKRSIPLEPSECYRVRVGDLVLCFQERSDQAVYCDAHIIEIQRRLHDIKGCRCIFVVRYDHDHGEEKVNLKRLCCRPTL

SEQ ID NO: 12 - protein, 279 aa, Cucumis sativus
MEHRKSSKLLDDSSFEFTLAEIVEMDNILKDSRDQTLGQEFFQDVALHFSCSPWRAAKSPVTTEHVHAWFENRRKELRASSKKARPPPPPPSELPPLPTPSSPPPSPPPKLLLYHSESDFLTHAPSSGPPEFKGKATDLSELAFEAFSSRDHAWYDVASFLTYRVNCHGELDARVRYAGFTKDEDEWVNVGRGVRDRSIPLESSECYRVKVGDLVLCFQERQDHALYFDAHVVEIQRRLHDIGGCRCIFVVRYEHDRHEEKVHIGRLCCRPSAFSSDQI

SEQ ID NO: 13 - protein, 276 aa, Arabidopsis lyrata
MAAPDDSSHYFTEFTLAEIRDSCFVILLYCSSSAKIVDMENLYKELGDQSLHKDFCQTVASTFSFMSSSIVSQSCSVNRNGKSTVTWKQIQSWFQEKLKQQSQPKFKTLPSPPLQIHDLSNPSCYAANATFVQTRKGKASDLADLAFEAKSARDYAWYDVSSFLTYRVLRTGELEVRVRFSGFDNRHDEWVNVKTSVRERSIPLEPSECGRVNIGDLLLCFQERDDQALYCDGHVVNIKRGIHDHRRCNCVFLVRYDLDNTEEPLGLEKICRRPDE

SEQ ID NO: 14 - protein, 349 aa, Arabidopsis thaliana
MGRPPSNGGPAFRFILPEVTEMEAILLQHNTAMPGRHILEALADKFSESPERKGKVVVQFKQIWNWFQNRRYALRARGNKAPGKLNVSSMPRMDLPNQMRSVIQPLSVPKTTHMTGNLPGMTPAPSGSLVPGVMRSGSDNSYLEFEAKSARDGAWYDVQAFLAHRNLEIGDPEVQVRFAGFEVEEDEWINVKKHVRQRSLPCEASECVAVLAGDLVLCFQEGKDQALYFDAIVLDAQRRRHDVRGCRCRFLVRYSHDQSEQEIVPLRKICRRPETDYRLQQLHNAVNDLANSNQHQIPALDAAAKTPLSLPGATVPIVAPESKDPSLSATPATLVQPSSNAATVPAGSA

SEQ ID NO: 15 - protein, 924 aa, A. Thaliana
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 16 - protein, 924 aa, A. Lyrata
MDSTNGNGADLESANGANGSGVVTDALPPPPPVIPPNVEPVRVKTELAEKKNLRVPMARKGFGTRGQKIPLLTNHFKVDVANLQGHFFHYSVALFYDDGRPVEAKGVGRKILDKVHETYHSDLDGKEFAYDGEKTLFTYGALPDNKMDFSVVLEEVSAARTNGNGSPNGNESPSDGDRKRLRRPNRSKNFRVEISYAAKIPLQALANAMRGQESENSQEAIRVLDIILRQHAARQGCLLVRQSFFHNDPSNCEQVGGNILGCRGFHSSFRTTQGGMSLNMDVTTTMIIKPGPVVDFLIANQNARDPYSIDWSKAKRTLKNLRVKVSPSNQEFRITGLSDKPCREQTFELKKRNPNENGEFDTTEVTVADYFREIRHIDLQYSADLPCINVGKPKRPTYIPLELCALIPLQRYTKALNTFQRSALVEKSRQKPQERMTVLSKALKVSNYDAEPLLRSCGISISSNFTQVEGRVLPAPKLKMGCGSETFPRNGRWNFNNKQFVEPTKIERWVVVNFSARCNVRQVVDDLIKIGGSKGIEIAPPFQVFEEGNQFRRAPPMNRVENMFKDIQSKLPGVPQFILCVLPEKKNCDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLFKKNGTEDDGIIKELLVDFYTSSNKRKPEHIIIFRDGVSESQFNQVLNIELDQIIEACKLLDANWNPKFLLLVAQKNHHTKFFQTSSPDNVPPGTIIDNKICHPKNNDFYLCAHAGMIGTTRPTHYHVLYDEIGFSPDELQELVHSLSYVYQRSTTAISVVAPICYAHLAAAQLGTFMKFEDQSETSSSHGGITAPGPISVAQLPKLKDNVANSMFFC

SEQ ID NO: 17 - protein, 915 aa, C. Sativus
MSSNEPDGNGADAVLPPPPPPPPIPPNVVPIQAELEQAPEIVKKKVVRVPIARRGLASKGQKISLLTNHFKVNVTNIEGHFFHYSVALAYEDGRPVDGKGVGRKVIDKVHETYNSELAGKDFAYDGEKSLFTVGPLPRNKLEFTVVLEDITSNRNNGNCSPDGHGSPNNGDRKRMKRPYRSKSFKVEISFAAKIPMQAIASALRGQESENFQEAIRVLDIILRQNASKQGCLLVRQSFFHNDPNSCTDVGGGVLGCRGFHSSFRTTQSGLSLNIDVSTTMIIQPGPVVDFLIANQNVRDPFSLDWTKAKRTLKNLRIKASPSNAEYKITGLSEKPCKEQTFTLKQKGGNDEDCIEITVYDYFVKHRNIELRYSSDLPCINVGKPKRPTFIPVELCSLVSLQRYTKALSTFQRASLVEKSRQKPQERMRVLSDSLRRNKYDAEPMLRSCGIAINSSFIQVEGRVLPAPKLKVGNGEDFFPRNGRWNFNNKKLAQPTKIERWAVVNFSARCDTRGLVRDLIKCGDMKGIAIEAPFDVFEENPQFRRAPPMVRVEKMFEEVQSKLPGQPQFLLCLLPERKNSDLYGPWKKKNLAEFGIVTQCIAPTRVNDQYLTNVLLKINAKLGGLNSLLAVEHSPSIPMVSKVPTIILGMDVSHGSPGQSDIPSIAAVVSSRQWPLISRYRAAVRTQSPKVEMIDSLYKRISDTEDDGIMRELLLDFYTSSGKRKPDQIIIFRDGVSESQFNQVLNVELDQIIQSCKFLDENWNPKFVVIVAQKNHHTKFFQPGSPDNVPPGTIIDNKICHPRNNDFYLCAHAGMIGTTRPTHYHVLLDEVGFSADDLQELVHSLSYVYQRSTTAISVVAPVCYAHLAATQIGQFIKFEETSETASSDGGLTSAGAVPVPQLPRLQEKVCNSMFFC

SEQ ID NO: 18 - protein, 913 aa, V. Vinifera
MDSGEDGNGAQDALPPPPPVPPNVVPIKADSVASEPVKKKVARVPIARRGFASKGQKIALTTNHFKVNVTGADGHFFHYSVSLSYEDGRPVDGKGIGRKVIDRVHETYDSELGGKDFAYDGEKSLFTVGPLPRNKLEFTVVLEDVSSNRNNGNGSPDRGSPNESDRKRMRRPYQSKTFKVEISFAAKIPMQAIANALRGQESENSQEALRVLDIILRQHASKQGCLLVRQSFFHNDPKNFIDLGGGVLGCRGFHSSFRTTQGGLSLNIDVSTTMIVQPGPVVDFLIANQNARDPFSLDWAKAKKMLKNLRVKTSPSNTEYKITGLSEKPCKEQLFTLKQRNGKDENGEAQTIEVTVFDYFVNHRRIELRYSADLPCINVGKPKRPTYFPIELCTLVSLQRYTKALSTLQRASLVERSRQKPQERIGVLTNALRSNNYDAEPMLRSCGISISRDLTQIEGRVLAAPRLKVGNGEDFFPRNGRWNFNNKKLVEPTKIERWAVVNFSARCDIRNLVRELIKCGGMKGIHIDPPFDVFEENPQSRRAPPIVRVEKMFEEIQSKLPGAPQFLLCLLPERKNSDLYGPWKRKNLSEYGIVTQCIAPTRVNDQYLTNVLLKINAKLGGLNSMLAVEHSPSIPIVSKGPTIILGMDVSHGSPGQSDVPSIAAVVSSRQWPLISRYRASVRTQSPKVEMIDSLYKRVSETEDEGIIRELLLDFYVSSGKRKPDQIIIFRDGVSESQFNQVLNIELDQIIEACKFLDEKWSPKFVVIVAQKNHHTKFFQHGSPDNVPPGTVIDNKVCHPRNNDFYLCAHAGMIGTTRPTHYHVLLDEVGFSSDDLQELVHSLSYVYQRSTTAISVVAPICYAHLAATQMSQFMKFEDTSETSSSQGGLTSAGPVPVPQLPKLQESVCNSMFFC

SEQ ID NO: 19 - protein, 948 aa, M. Truncatula
MHRTNFIHILFVLFSNFIHFTAQNTLHSFFSFLSQTFFKEMGSQENEECLPPPPPIVPADIEPIKIEPQIVKKKLPTKVPMARRGLGSKGAKLPLLTNHFKVNVTNTDGYFFQYSVALFYEDGRPVEGKGAGRKILDRVQETYGSELNGKDLAYDGEKTLFTIGSLAQNKLEFTVVLEDVTSNRNNGNASPDGHGSPNDTDRKRLKKSHRSKTYKVEISFASKIPLQAIANALKGHETENYQEAIRVLDIILRQHAAKQGCLLVRQNFFHNDPKNFTDVGGGVLGCRGLHSSFRTTQSGLSLNIDVSTTMIVHPGPVVDFLIANQNVRDPFSLDWNKAKRTLKNLRITTSPTNQEYKITGLSEMPCKDQLFTLKKRGAVPGEDDTEEITVYDYFVNRRKISLQYSADLPCINVGKPKRPTFVPVELCSLVSLQRYTKALSTLQRSSLVEKSRQKPQERMRVLTDALKTSDYGSEPMLRNCGISITSGFTQVDGRVLQAPRLKFGNGEDFNPRNGRWNFNNKKIVQPVKIEKWAVVNFSARCDVRGLVRDLIKCGGMKGIHVEQPFDCFEENGQFRRAPPLVRVEKMFEHVQSKLPGAPKFLLCLLSERKNSDLYGPWKKKNLAEFGIVTQCIAPTRVNDQYLTNVLLKINAKLGGMNSLLGVEHSPSIPIVSKAPTLILGMDVSHGSPGQTEIPSIAAVVSSRQWPLISKYRACVRTQGAKVEMIDNLFKPVSDTEDEGIIRELLIDFYNSSGNRKPDNIIIFRDGVSESQFNQVLNIELSQIIEACKFLDEKWNPKFLVIVAQKNHHTKFFQPGSPDNVPPGTVVDNKICHPRNYDFYMCAHAGMIGTSRPTHYHVLLDEIGFSPDDLQELVHSLSYVYQRSTTAISVVAPICYAHLAASQVGQFMKFEDKSETSSSHGGSGRDINASPIPQLPKLMDSVCNSMFFV

SEQ ID NO: 20 - protein, 921 aa, R. Communis
MDSFEPDGNGLREGNGIHEGNGSQEGLPPPPPVVPPDVVPMRAEPEPVKKKVVRVPIARRGLGSKGQKISLLTNHFKVNVNKVDDYFFHYCVSLSYEDGRPVDGKGVGRKVIDRVHETYDSEMGGKKFAYDGEKSLFTVGALPRNKLEFTVVLEDVTSNRNNGNASPDGHGSPNEGDRKRMRRPYQSKTFKVEISFAAKIPMQAIANALRGQESENSQEAIRVLDIILRQHAAKQGCLLVRQNFFHNDPKNFADVGGGVLGCRGFHSSFRTTQGGLSLNIDVSTTMIIQPGPVVDFLIANQNVRDPFQLDWAKAKRTLKNLRIKASPSNQEYKITGLSEMPCKEQTFQLNQKGRDDNDPLELTVYDYFVNHRRIELRYSGDLPCINVGKPKRPTFIPIELCSLVSLQRYTKALNTLQRASLVEKSRQKPQERMSTLSNALKSSNYDAEPMLRSCGVSISTSFVQVDGRQLQAPKLKVGNGEDFFPRNGRWNFNNKKLVDPSKIERWAVVNFSARCDIRNLVRDLTKCAEMKGIPIEPPFDVFEENPQFRRAPPTVRVEKMFDSIQSKLPGAPKFLLCLLPERKNSDLYGPWKKKNLSDFGIVTQCIAPQRVNDQYLTNVLLKINAKLGGLNSMLAVEHSPSIPLVSKVPTIIIGMDVSHGSPGHSDVPSIAAVVSSRQWPLISRYRACVRTQSPKVEMIDSLYKPVSDTEDEGMMRELLLDFYSSSGKRKPEQIIIFRDGVSESQFNQVLNIELNQIIEACKHLDEKWNPKFVVIIAQKNHHTKFFQPGLPDNVPPGTVIDNKVCHPRNNDFYLCAHAGMIGTTRPTHYHVLLDEVGFSADELQELVHSLSYVYQRSTTAISVVAPVCYAHLAATQMGQFMKFEDASETSSSHGGVTSAGAVPVPQMPKLSDKVSSSMFFC

SEQ ID NO: 21 - protein, 906 aa, G. Max
MASFGPNGTENEDSLPPPPPVVPSDVVPVKAEPEKKKASRFPIARRGLASKGTKLQLLTNHYRVNVANTDGHFYQYSVALFYDDGRPVEGKGVGRKLLDRVHETYDSELNGKDFAYDGEKTLFTLGSLARNKLEFTVVLEDVIATRNNGNCSPEGNGELNESDKKRMRRPNRSKAFKVELSYASKIPLQAIANALRGQESENYQEAIRVLDIILRQHAAKQGCLLVRQSFFHNNPKNFADVGGGVLGCRGFHSSFRTTQSGLSLNIDVSTTMIITPGPVVDFLISNQNVRDPFSLDWAKAKRTLKNLRIKSSPSNQEFKITGLSELPCKDQMFTLKKKGGDDDTEEEVTVYDYFVNIRKIDLRYSGDLPCINVGKPKRPTYIPLELCSLVSLQRYTKALSTLQRSSLVEKSRQKPQERMRVLSDALKSSNYGSEPMLRNCGISISPNFTEVEGRVLQAPRLKFGNGEDFNPRNGRWNFNNKKIVKPTKIERWAVVNFSARCDIRGLVRDLIKCGGMKGIVIDQPFDVFEENGQFRRAPPVVRVEKMFELVQSKLPGAPQFLLCLLPERKNSDLYGPWKKKNLAEFGIVTQCIAPTRVNDQYLTNVLLKINAKLGGLNSMLGVEHSPSIPIVSRAPTIIIGMDVSHGSPGQTDIPSIAAVVSSREWPLISKYRASVRTQSPKMEMIDNLFKKVSDKEDEGIMRELLLDFYTSSGNRKPDNIIIFRDGVSESQFNQVLNIELDQIIEACKFLDEKWNPKFLVIVAQKNHHTKFFQPGAPDNVPPGTVIDNKICHPRNYDFYMCAHAGMIGTSRPTHYHVLLDEIGFSPDDLQELVHSLSYVYQRSTTAISVVAPICYAHLAATQMGQFMKFEDKSETSSSHGGSGIPAPPVPQLPRLQDKVSSSMFFC

SEQ ID NO: 22 - protein, 898 aa, Z. mays
MESHNGEADDLPPPPPLAAGVEPLKADETKMPLKPRSLVQRNGFGRKGQQIKLITNHFKVSLMKAEDFFYHYYVNLKYEDDTPVDRKGSGRKVIEKLQQTYAAELANKDFAYDGEKSLFTIGALPQVKMEFTVVDEDVSTGKTPANGSPGNDSPPGSDRKRVRRPYNTKTYKVELSFAAKIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLIANQKVNDPSMIDWAKAKRSLKNLRIKTSPANQEQKIVGLSDRPCREQLFTLKHKNGESEEITVFDYFVKNRGIKLEYSGDLPCINVGKPKRPTYFPVELCSLLPLQRYTKALSTLQRSSLVEKSRQKPQERMSVLSDVLQRSNYDAEPMLKACGITIARNFIEVDGRVLQPPKLKAGNGEDIFTRNGRWNFNNKKLIRASSVEKWAVVNFSARCNVRDLVRDLIKCGGMKGIMVDAPFAVFDENPSMRRSPAVRRVEDMFEQVKTKLPGAPKFLLCVLAERKNSDIYGPWKKKCLAEFGIVTQCVAPTRVNDQYLTNVLLKINAKLGGLNSLLQIETSPAIPLVSKVPTIILGMDVSHGSPGHSDIPSVAAVVSSREWPLISKYRASVRTQSPKMEMIDSLFKPRETDDDGLIRECLIDFYTSSGKRKPDQVIIFRDGVSESQFNQVLNIELQQIIEACKFLDEKWNPKFTLIIAQKNHHTKFFIPGKPDNVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 23 - protein, 909 aa, S. Bicolor
MGSHDGEDEELPPPPPVPPDVVPIKAEDVVGEPPANKPIKPKRLLMDRPGIGRKGQLAQLYSNHFKVAVKSTEDFFFHYYVNLKYEDDQPVEGKGIGRKVIDKLQQTYRAELSNKDFAYDGEKSLFTVGGLPQKNNEFTVVLEDASTGKTAANGSPGGNDSPGGGDRKRVRRPYQTKTFKVEINFAAKVPMSAIGQVIRGEETENSLEALRVLDIILRQHSAEQGCLLVKQSFFYNNPSNFVDLGGGVMGCRGFHSSFRGTQSGLSLNVDVSTTMIVKPGPVIDFLLSNQNVNDPSRIDWQKAKRALKGLRIRTTPANAEFKIFGLSERICKEQTFPLRQRNGSNGDCDTIDITVYDYYAKKGIDLKYSGDLPCINTGRAKRPTYFPIELCCLVPLQRYTKALSTLQRSSLVEKSRQKPQERMTVLNDALQRSNYDSDPMLRACGVSVAPKFTQVEGRILQAPKLKAGNGDDIFSRNGRWNFTNRKFYQTCSVDKWAVVNFSARCDVRNLIRDLMRNASAKGIQMEEPFDVFEESPSMRRAPVSRRVDDMFGQIKSKLPGAPRFLMCLLPERKNCEVYGPWKRKCLAEFGIVTQCLAPTRVNDPYLLNLLMKINAKLGGLNSLLQVEASPSIPHVSEVPTIILGMDVSHGHPGQDRPSVAAVVSSRQWPLISKYRASVHTQSARLEMMSSLFKPRGTDDDGLIRESLIDFYTSSGKRKPDHIIIFRDGVSESQFTQVINIELDQIIEACKFLDEKWSPKFTVIVAQKNHHTKFFQTGSPDNVLPGTVVDNKVCHPKNFDFYMCAHAGMIGTTRPTHYHVLHDEIGFSADEMQEFVHSLSYVYQRSTTAISVVAPICYAHLAAAQVGTFLKFEEMSDTSSSQGGHTSAGSAPVPELPRLHEKVRSSMFFC

SEQ ID NO: 24 - protein, 911 aa, O. Sativa
MDAHDGEADELPPPPPVPANVVPIKADDVESEVPANKPAKPKRFPMARPGLGRKGQPIQLLANHYKVSVKSSEEYFFHYNVILKYEDDRPVDGKGVGRKVIDKLQQTYRSELSSKDFAYDGEKSLFTIGALPQVTNEFTVVLEDVSTGKTAANGSPGGNDSPGGSDRKRVRRPYQTKTFKVELCFAAKIPMNAIAQAIKGQESENSQEALRVLDIILRQHSAKQGCLLVRQSFFHNNPNNFVDLGGGVMGCRGFHSSFRGTQSGLSLNIDVSTTMIVKPGPVIDFLLANQKVDHPDRIDWQKAKRALKNLRIRTTPVNSEFKIIGLSDRNCNEQMFSLRQRNGNNGDVDEVEVTVYDYFVKNKGIELRYSGNLPCINVGKPKRPTYFPIELCSLIPLQRYTKALSTLQRSSLVEKSRQKPQERMSVLNDALRHSNYDSDPMLRASGISIAQNFTQVEGRVLQPPKLKAGNGEDIFPRNGRWNFNNKKLIQTCSVDKWAVVNFSARCDVRNLIRDLIRNASAKGIQMAEPFDVFEESPSLRRAPVSRRVDDMFEQIKSKLPGAPKFLLCLLPERKNCEVYGPWKRKCLAEFGIVTQCLAPQRVNDQYLLNLLLKINAKLGGINSLLQIEASPSIPLVSKTPTIILGMDVSHGQPGQSDRPSIAAVVSSRQWPLISKYRASVHTQSPKLEMMSSLFKPRGTEDDGLIRESLIDFYTSSGKRKPDHVIVFRDGVSESQFTQVINIELDQIIEACKFLDEKWSPKFTVIVAQKNHHTKFFQSGSPDNVPPGTVVDKQVCHPRNYDFYMCAHAGMIGTTRPTHYHVLHDEIGFSPDDLQELVHSLSYVYQRSTTAISVVAPICYAHLAAAQVGTFLKFEDMSDASSSQGGHTSVGSVPVPELPRLHEKVRSSMFFC

SEQ ID NO: 25 - protein, 924 aa, B. Distachyon
MESHDGVADDLPPPPPLPPSIEPLKPEEADDLPPPPPLPPNVEPIKVEDAKKPRRTLISRPGFGKNGKPIQLVTNHFKVSLKTTDEFFHHYYVNLKYEDDRPVDGKGVGRKVIDKLQQTYASELAHKDFAYDGEKSLFTIGALPQVNNEFVVVLEDVSSGKTAANGSPGNDNSPGSDRKRVRRPYQTKTFKVELNFASRIPMSSIAMALQGQESEHTQEAIRVIDIILRQHAAKQGCLLVRQSFFHNNPSQFVDLGGGVMGCRGFHSSFRATKSGLSLNIDVSTTMIVKPGAVVDFLIANQKVDHPNKIDWAKAKRALKNLRIKTSPANTEFKIVGLSERNCYEQMFSLKQRNNGNGDSEAIEISVYDYFVKNRGIELRYSGDFPCINVGKPKRPTYFPIELCSLVPLQRYTKSLSTLQRSSLVEKSRQKPQERMSVLSDVLKRSSYDTDPMLKACGISIAQGFTQVPGRVLQPPKLKAGNGEDIFTRNGRWNFNNKRLVRASCVERWAVVNFSARCNCNDLVRDLIKCGGMKGIKVDQPFDVFEENSSMRRAPAPKRVEAMFETVKTKLPGAPKFLLCILAERKNSDVYGPWKRKCLAEFGIVTQCVAPTRVNDQYLTNVLLKINAKLGGMNSLLQIELSPAIPLVSKVPTMILGMDVSHGSPGQADTPSIAAVVSSREWPLVSKYRASVRSQSPKSEMIDSLFKPQGTEDDGLIRECLIDFYTSSGKRKPDQIIIFRDGVSESQFTQVLNKELDQINEACKFLDESWSPKFTLIVAQKNHHTKFFIPGSPDNVPPGTVVDNVVCHPKNYDFYMCAHAGMIGTTRPTHYHILHDDIHFTADDLQDLVHSLSYVYQRSTTAISVVSPICYAHLAAAQVSQFVKFDEMSETSSSQGGGGHTSAGSTPVQELPRLHEKVRSSMFFC

SEQ ID NO: 26 - protein, 911 aa, P. Trichocarpa
MESADEQNGNGSQEALPPPPPDVPPNVVPVKAEPEPVKKKPLRVPIARRGLGSKGQKMPLLTNHFKVNVTNTEGYFFHYCVSLAYEDGRPVDGKGVGRKVIDRVHETYDTEFGKDFAYDGEKSLFTVGPLPRNKLEFTVVLEDVVSNRNNGNASPDGHGSPNEGDRKRLRRPYHSKTFKVEISFAAKIPMQAIANALRGQESENSQEAFRVLDIILRQHAAKQGCLLVRQSFFHNDPKNFVDLGGGVLGCRGFHSSFRTSQGGLSLNIDVSTTMIIQPGPVVDFLIANQNVRDPFSLDWAKAKRMLKNLRVKASPSNQEYKITGLSEKTCKEQMFQLKQKNGGDGGIEAVEITVYDYFVNHRKIDLRYSGDLPCINVGKPKRPTYIPLELCSLVSLQRYTKALSTLQRSSLVEKSRQKPQERMTVLSSALKSSKYDAEPMLRSCGISINPSFTQVEGRVLPAPKLKVGNGEDFFPRNGRWNFNNKKLVEPSRIEKWAVVNFSARCDIRNLVQNLTKCAEMKGIPIEDPFDVFEENPQSRRAPPVVRVEKMFEQIQSRLPGQPKFLLCLLPERKNSDIYGPWKRKNLAEYGIVTQCIAPQRVNDQYITNVLLKINAKLGGLNSMLAVEHAPSLPLVSKVPTLILGMDVSHGSPGQSDVPSIAAVVSSRQWPLISRYRACVRTQSPKLEMIDSLFKRVSETEDEGIIRELLLDFYVTSGKRKPDQIIIFRDGVSESQFNQVLNIELDQIIEACKFLDEKWSPTFVVIVAQKNHHTKFFQPGSPDNVPPGTIIDNKVCHPRNNDFYLCAHAGMIGTTRPTHYHVLLDEVGFSADDLQELVHSLSYVYQRSTTAISVVAPICYAHLAATQMGQFMKFEDTSETSSSHGGVTSAGAVPVPQLPRLQEKVCNSMFFC

SEQ ID NO: 27 - protein, 922 aa, B. Napus
MDASTGNGAELESANGSGVSDALPPPPPIIPPNVEPVRVQTEVAVKKNLRVPMDRTGFGSKGQKIQLLTNHFGVKVANLQGFFYHYSVALFYDDGRPVEQKGVGRKVLDKVHETYHSDLDGKQFAYDGEKTLFTFGALPSNKMDFSVVLEEVSSARTTGNASPNGNEEPSDGDRKRLRRPNRSKSFRVEISYAAKIPLQALANAMRGQESENSQEAIRVLDIILRQHAARQGCLLVRQSFFHNDPSNCEPVGGNILGCRGFHSSFRTTQGGMSLNMDVTTTMIIKPGPLVDFVIANQGAKDPFTVDWSKAKRTLKNLRIKVSPSNQEYRITGMSDKPCREQTFEYRPRNAPKNENGESETIEITVYDYFLRERNLELQYSADLPCVNVGRPKRPTYIPLEHCTLIPLQRYTKALNTFQRSALVEKSRQKPQERMNVLSKALKVSNYDAEPLLRSCGISISSNFTQVEGRVLPAPKLKMGRGDELFPRNGRWNFNNKQFVEPTKIDKWAVANFSARCNVRQLVDDLIRIGGMKGIEIAAPFDVFEEGHQFRRAPPMIRVEKMFEEIQSKLPGAPQFLLCLLPERKNCDIYGPWKKKNLTEYGIVTQCMAPVRQPNDQYLTNCLLKINAKLGGLNSMLSVERTPAFTVISKVPTIILGMDVSHGSPGQSDVPSIAAVVSSRQWPLVSKYRASVRTQPSKAEMIESLVKKNGTEDDGIIKELLVDFYTSSGKRKPEHIIIFRDGVSESQFNQVLNIELDQIIEACKLLDENWNPKFLLLVAQKNHHTKFFQPNSPDNVPPGTIIDNKICHPKNNDFYLCAHAGMIGTTRPTHYHVLYDEIHFSPDELQELVHSLSYVYQRSTTAISVVAPICYAHLAAAQLGTFMKFEDQSETSSSHGGVTAPGPVSVAQLPKLKDNVANSMFFC

SEQ ID NO: 28 - protein, 471 aa, A. thaliana
MEADESGISLPSGPDGRKRRVSYFYEPTIGDYYYGQGHPMKPHRIRMAHSLIIHYHLHRRLEISRPSLADASDIGRFHSPEYVDFLASVSPESMGDPSAARNLRRFNVGEDCPVFDGLFDFCRASAGGSIGAAVKLNRQDADIAINWGGGLHHAKKSEASGFCYVNDIVLGILELLKMFKRVLYIDIDVHHGDGVEEAFYTTDRVMTVSFHKFGDFFPGTGHIRDVGAEKGKYYALNVPLNDGMDDESFRSLFRPLIQKVMEVYQPEAVVLQCGADSLSGDRLGCFNLSVKGHADCLRFLRSYNVPLMVLGGGGYTIRNVARCWCYETAVAVGVEPDNKLPYNEYFEYFGPDYTLHVDPSPMENLNTPKDMERIRNTLLEQLSGLIHAPSVQFQHTPPVNRVLDEPEDDMETRPKPRIWSGTATYESDSDDDDKPLHGYSCRGGATTDRDSTGEDEMDDDNPEPDVNPPSS

SEQ ID NO: 29 - protein, 471 aa, A. lyrata
MEADESGISLPSGPDGRKRRVSYFYEPTIGDYYYGQGHPMKPHRIRMAHSLIIHYHLHRRLEISRPNLADASDIGRFHSPEYVDFLASVSPESMGDPSSSRNLRRFNVGEDCPVFDGLFDFCRASAGGSIGAAVKLNRQDADIAINWGGGLHHAKKSEASGFCYVNDIVLGILELLKMFKRVLYIDIDVHHGDGVEEAFYTTDRVMTVSFHKFGDFFPGTGHIRDVGAEKGKYYALNVPLNDGMDDESFRSLFRPLIQKVMEVYQPEAVVLQCGADSLSGDRLGCFNLSVKGHADCLRFLRSYNVPLMVLGGGGYTIRNVARCWCYETAVAVGVEPDNKLPYNEYFEYFGPDYTLHVDPGPMENLNTPKDMEKIRNTLLEQLSGLIHAPSVQFQHTPPVNRVLDEPEEDMEQRPKPRIWSGTVTYESDSDDDDKPLHGYSGRGGATMDRDSTGEDEMEDDNPEPDVNPPSS

SEQ ID NO: 30 - protein, 465 aa, C. Sativus
MSDDIHGGASLPSGPDGRKRRVTYFYEPTIGDYYYGQGHPMKPHRIRMAHNLIVHYGLHRRMEINRPYPAGPEDIRRFHSDDYVDFLASVSPETLSDHAFSRHLKRFNVGEDCPVFDGLFGFCQASAGGSIGAAVKLNRGDADIAINWAGGLHHAKKSEASGFCYVNDIVLGILELLKYHKRVLYIDIDVHHGDGVEEAFYTTDRVMTVSFHKFGDFFPGTGHIKDVGVGTGKNYALNVPLNDGMDDDSFRGLFRPLIQKVMEVYQPDAVVLQCGADSLSGDRLGCFNLSVKGHADCLRFLRSFNVPLMVLGGGGYTIRNVARCWCYETAVAVGVEPDNKLPYNEYFEYFGPDYALHIEPSNMENLNSPKDMEKIRNTLLEQLSRLPHAPSVPFQMTPSSEIPEEVEESIERRPKRRIWNGEDYDSDSEENRKRPNISEGTGVNNLTRDVVDDMEEDKNMGHQCC

SEQ ID NO: 31 - protein, 464 aa, V. Vinifera
MEDGIGGASLPSGPDAKKRRVCYFYEPTIGDYYYGQGHPMKPHRIRMAHNLVVHYALHRRMEINRPFPAGPDDIRRFHSDDYVDFLASVTPDSLHDHAHSRYLKRFNVGEDCPVFDGLFGFCQASAGGSIGAAVKLNRRDADIALNWAGGLHHAKKSEASGFCYVNDIVLGILELLKVHRRVLYVDIDIHHGDGVEEAFFTTDRVMTVSFHKFGDFFPGTGHIRDIGVGPGKYYALNVPLNDGMDDESFRGLFRPIIQKVMAVYQPDAVVLQCGADSLSGDRLGCFNLSVNGHADCLRFLRSFNVPLMVLGGGGYTIRNVARCWCYETAVAVGVEPDNKLPYNEYYEYFGPDYTLHIEPCNMENQNSPKDLEKIRNMLLEQLSRLPHAPSVPFQTTPPITKVPEEEEEDMDKRPKPRIWNGEDCESDPDEDEKPRAQFSNTNHHPTSNVEMRGVTGKIKEEKTT

SEQ ID NO: 32 - protein, 476 aa, M. Truncatula
MGSGEMGVAESGGASLPSIGADAMKRRVTYFYEPSIGDYYYGQGHPMKPHRIRMAHNLIIHYSLHRRMQINRPFAAAPEDIRRFHSDDYVEFLSSVSPEIVSDNSHSHYRQLKRFNVGEDCPVFDGLFPFCQASAGGSIGAAVRLNRGDADIAINWAGGLHHAKKAEASGFCYVNDIVLGILELLKVHRRVLYVDIDVHHGDGVEEAFYTTDRVMTVSFHKFGDFFPGTGHIKDTGVGPGKDYALNVPLNDGMDDENFRALFRPIMQKVMDVYQPDAVVLQCGADSLSGDRLGCFNLSVKGHADCLRFLRSFNVPLMVLGGGGYTVRNVARCWCYETAVAVGVEPSNKLPYNEYYEYFGPDYTLHVEPNNMENLNTPKDMEKIRNTLLEQIARLPHAPSAPFQTTPSTAEVPEVEEEDMDIRPKRQLWSGEDYDSDPDEDEKANIRSSSLTSHMRRAADMMEEDKPEVKPGVHPPC

SEQ ID NO: 33 - protein, 468 aa, R. Communis
MGDETGGASLPSTGTDAKKRRVTYFYEPTIGNYYYGQGHPMKPHRIRMAHNLIVHYSLHRRMEINRPFPASTIDIRKFHSDDYVDFLSSVSPESLADPAHNRHLKRFNVGEDCPVFDGLFGFCQASAGGSMGAAVKLNRGDADIALNWAGGLHHAKKSEASGFCYVNDIVLGILELLKVHRRVLYVDIDVHHGDGVEEAFYTTDRVMTVSFHKFGDFFPGTGHIKDTGAGQGKNYALNIPLNDGMDDVSFRALFRPIIQKVMEVYQPDAVVLQCGADSLTGDRLGCFNLSVKGHADCLRFLRSFNVPLMVLGGGGYTIRNVARCWCYETAVAVGVEPDNKLPYNEYYEYFGPDYTLHIDPSNMENLNSPKDMERIRNILLEQLSKLPNAPSVPFQTTPAITEVPEEGDEEMDRRPKRRIWDGEGYESPDEDEKPQPRRLNSDGLVAKDEMRDHIDEMEEDKKDVHPQC

SEQ ID NO: 34 - protein, 476 aa, G. max
MGMEEESSNNSSIIEGGASLPSTGSDAKKRRVTYFYEPTIGDYYYGQGHPMKPHRIRMAHNLIVHYSLHRRMEINRPFPASPADIRRFHSDDYVDFLSSVSPETLADSAFSRHLKRFNVGEDCPVFDGLFPFCQASAGGSLGAAVKLNRADADIAINWAGGLHHAKKSEASGFCYVNDIVLGILELLKVHRRVLYVDIDVHHGDGVEEAFYTTDRVMTVSFHKFGDFFPGTGHVKDIGVGSGKNYAVNVPLNDGMDDESFRSLFRTIIQKVMEVYQPEAVVLQCGADSLSGDRLGCFNLSVRGHADCLRFLRSFNVPLMVLGGGGYTIRNVARCWCYETAVAVGVEPDNKLPYNEYYEYFGPDYTLYVDPSNMENLNTPKDMEKIRNTLLEQISQLPHAPGVPFQTTPPTLQLPEEAEEDMDRRPKLRKWDGEDYDSDPDEGGKANSKFPNVTAHMRDITDEMEEEKPEVHPSSCC

SEQ ID NO: 35 - protein, 458 aa, Z. mays
MAASGEGVSLPSPAGGEDAHRRRVSYFYEPSIGDYYYGQGHPMKPHRIRMAHSLVVHYGLHRLLELSRPYPASEADIRRFHSDDYVAFLASATGNPGVLDPRAIKRFNVGEDCPVFDGLFPFCQASAGGSIGAAVKLNRGDADITVNWAGGLHHAKKSEASGFCYVNDIVLAILELLKFHRRVLYVDIDVHHGDGVEEAFFTTNRVMTVSFHKYGDFFPGTGHITDVGAAEGKHYALNVPLSDGIDDTTFRGLFQCIIKKVMEVYQPDVVVLQCGADSLAGDRLGCFNLSVKGHADCLRFLRSYNVPMMVLGGGGYTIRNVARCWCYETAVAVGVEPDNKLPYNDYYEYFGPDYTLHIQPKSVENLNTTKDLENIKNMILENLSKIEHVPSTQFHDRPSDPEAPEEKEEDMDKRPPQRSRLWSGGAYDSDTEDPDSLKSEGKDVTANFQMKDEPKDDL

SEQ ID NO: 36 - protein, 458 aa, S. Bicolor
MAASGEGASLPSPAGGEDAHRRRVSYFYEPSIGDYYYGQGHPMKPHRIRMAHSLVVHYGLHRLLELSRPYPASEADIRRFHSDDYVAFLASATGNPSVLDPRAVKRFNVGEDCPVFDGLFPFCQASAGGSIGAAVKLNRGDADITVNWAGGLHHAKKSEASGFCYVNDIVLAILELLKFHRRVLYVDIDVHHGDGVEEAFFTTNRVMTVSFHKYGDFFPGTGHITDVGAAEGKHYALNVPLSDGIDDATFRDLFQCIIKKVMEVYQPDVVVLQCGADSLAGDRLGCFNLSVKGHADCLRFLRSYNVPMMVLGGGGYTIRNVARCWCYETAVAVGVEPDNKLPYNDYYEYFGPDYILHIQPKSVENQNTTKDLENIKNMILESLSKIEHVPSTQFHDRPSDPEAPEEKEEDMDKRPAQRSRLWSGGAYDSDTEDPDNLKSESKDVTANLQMKDEPKNDL

SEQ ID NO: 37 - protein, 458 aa, O. Sativa
MAASGEGASLASAAGGEDGRRRRVSYFYEPSIGDYYYGQGHPMKPHRIRMAHSLVVHYGLHRLLELSRPYPASDADIRRFHSDDYVAFLASATGNPALLDARAVKRFNVGEDCPVFDGLFPFCQASAGGSIGAAVKLNRGDADITVNWAGGLHHAKKGEASGFCYVNDIVLAILELLKFHRRVLYVDIDVHHGDGVEEAFFTTNRVMTCSFHKYGDFFPGTGHITDVGAGEGKHYALNVPLSDGIDDDTFRDLFQCIIKKVMEVYQPDVVVLQCGADSLAGDRLGCFNLSVKGHADCLRYLRSFNIPMMVLGGGGYTIRNVARCWCYETAVAVGVEPDNKLPYNDYYEYFGPDYNLHIQPRSVENLNSTKDLENIKSMILDHLSKIEHVPSTQFHDRPSDPEAPEQEEEDMDKRPPQRSRLWSGGAYESDTEDPDNMKTETNDLSASSVMKDESNDDS

SEQ ID NO: 38 - protein, 457 aa, B. Distachyon
MAASGEGASLPSPAGGEDGRRRRVSYFYEPTIGDYYYGQGHPMKPHRIRMAHSLVVHYGLHRLLELSRPFPASEADISRFHSEEYVSFLASATGNPNILDPRAVKRFNVGEDCPVFDGLFPFCQASAGGSIGAAVKLNRGDADITVNWAGGLHHAKKGEASGFCYVNDIVLAILELLKFHRRVLYVDIDVHHGDGVEEAFFTTNRVMTVSFHKYGDFFPGTGHITDVGAGEGKHYAVNVPLSDGIDDSTFRDLFQCIMKRVMEVYQPEVVVLQCGADSLAGDRLGCFNLSVKGHADCLRYLRSFNVPMMVLGGGGYTIRNVARCWCYETAVAVGVEPDNKLPYNDYYEYFGPDYNLHIEPRSVENLNTTKDLENIKNMILDHLSTLEHVPNTQFHDRPSDPEAPAEKEEDMDKRPSQRSRLWSGGAYDSDTEDPDMKTEANDLIANSIVKDESNDDL

SEQ ID NO: 39 - protein, 467 aa, P. trichocarpa
MEDITGGASLPSTGTDAKKRRVTYFYEPTIGDYYYGQGHPMKPHRIRMAHNLIVHYALHRRMEINRPFPAGPTDIRKFHSDEYVEFLSSVSPQSVGDPAFGRQLKRFNVGEDCPVFDGLFGFCQASAGGSIGAAVKLNRGDADIALNWAGGLHHAKKSEASGFCYVNDIVLGILELLKVHRRVLYVDIDVHHGDGVEEAFYTTDRVMTVSFHKYGDFFPGTGHIKDTGAGQGKSYALNIPLNDGMDDENFRGLFRPLIQKVMEVYQPDAVVLQCGADSLSGDRLGCFNLSVKGHADCLRFLRSYNVPLMVLGGGGYTIRNVARCWCYETAVAVGVEPDNKLPYNEYFEYFGPDYTLHVEPSNVENLNSPKDMERIRNILLEQLSRLPNAPSVPFQTTPPTTEVPEEAEEDMDQRPKRRIWNGEDFESDHDEDEKPGPRFFNADAQPNNKIRDGVDAMEEDKKEHPGL

SEQ ID NO: 40 - protein, 505 aa, B. Napus
METDESGVSLASGPDGRKRRVSYFYEPTIGNYYYGQGHPMKPHRIRMAHSLIVHYNLHRRLEISRPYLADAADIGRFHSPEYVDFLRSVSPESVGDSSARNLRRFNVGEDCPVFDGLFEFCRASAGGSIGAAVKLNRQDADIAINWGGGLHHAKKSEASGFCYVNDIVLGILELLKMFRRVLYIDIDVHHGDGVEEAFYTTDRVMTVSFHKFGDFFPGTGHIRDVGAEKGKYYALNVPLNDGMDDESFRSLFRPLIQKVMEVYRPEAVVLQCGADSLSGDRLGCFNLSVKGHADCLRFLRSYNVPLMVLGGGGYTIRNVARCWCYETAVAVGVEPDNKLPYNEYFEYFGPDYTLHVEPGPMENLNTPKDMERIRNTLLEQLSGLIHAPSVPFQHTPPVNRVLDEPEEDLEKRPKPRIWSGTANYESDSDDDEKPLGGFSGINGPTMDRDSTGEDEMEDDSAEPEKPFCFGLKTYLIGIAAIAKDALYTSVKTGFSAICSNTWIWE

SEQ ID NO: 41 - protein, 1453 aa, Arabidopsis thaliana
MEDDCEELQVPVGTLTSIGFSISNNNDRDKMSVLEVEAPNQVTDSRLGLPNPDSVCRTCGSKDRKVCEGHFGVINFAYSIINPYFLKEVAALLNKICPGCKYIRKKQFQITEDQPERCRYCTLNTGYPLMKFRVTTKEVFRRSGIVVEVNEESLMKLKKRGVLTLPPDYWSFLPQDSNIDESCLKPTRRIITHAQVYALLLGIDQRLIKKDIPMFNSLGLTSFPVTPNGYRVTEIVHQFNGARLIFDERTRIYKKLVGFEGNTLELSSRVMECMQYSRLFSETVSSSKDSANPYQKKSDTPKLCGLRFMKDVLLGKRSDHTFRTVVVGDPSLKLNEIGIPESIAKRLQVSEHLNQCNKERLVTSFVPTLLDNKEMHVRRGDRLVAIQVNDLQTGDKIFRSLMDGDTVLMNRPPSIHQHSLIAMTVRILPTTSVVSLNPICCLPFRGDFDGDCLHGYVPQSIQAKVELDELVALDKQLINRQNGRNLLSLGQDSLTAAYLVNVEKNCYLNRAQMQQLQMYCPFQLPPPAIIKASPSSTEPQWTGMQLFGMLFPPGFDYTYPLNNVVVSNGELLSFSEGSAWLRDGEGNFIERLLKHDKGKVLDIIYSAQEMLSQWLLMRGLSVSLADLYLSSDLQSRKNLTEEISYGLREAEQVCNKQQLMVESWRDFLAVNGEDKEEDSVSDLARFCYERQKSATLSELAVSAFKDAYRDVQALAYRYGDQSNSFLIMSKAGSKGNIGKLVQHSMCIGLQNSAVSLSFGFPRELTCAAWNDPNSPLRGAKGKDSTTTESYVPYGVIENSFLTGLNPLESFVHSVTSRDSSFSGNADLPGTLSRRLMFFMRDIYAAYDGTVRNSFGNQLVQFTYETDGPVEDITGEALGSLSACALSEAAYSALDQPISLLETSPLLNLKNVLECGSKKGQREQTMSLYLSEYLSKKKHGFEYGSLEIKNHLEKLSFSEIVSTSMIIFSPSSNTKVPLSPWVCHFHISEKVLKRKQLSAESVVSSLNEQYKSRNRELKLDIVDLDIQNTNHCSSDDQAMKDDNVCITVTVVEASKHSVLELDAIRLVLIPFLLDSPVKGDQGIKKVNILWTDRPKAPKRNGNHLAGELYLKVTMYGDRGKRNCWTALLETCLPIMDMIDWGRSHPDNIRQCCSVYGIDAGRSIFVANLESAVSDTGKEILREHLLLVADSLSVTGEFVALNAKGWSKQRQVESTPAPFTQACFSSPSQCFLKAAKEGVRDDLQGSIDALAWGKVPGFGTGDQFEIIISPKVHGFTTPVDVYDLLSSTKTMRRTNSAPKSDKATVQPFGLLHSAFLKDIKVLDGKGIPMSLLRTIFTWKNIELLSQSLKRILHSYEINELLNERDEGLVKMVLQLHPNSVEKIGPGVKGIRVAKSKHGDSCCFEVVRIDGTFEDFSYHKCVLGATKIIAPKKMNFYKSKYLKNGTLESGGFSENP

SEQ ID NO: 42 - protein, 1456 aa, Arabidopsis lyrata
MEDDCEELQVPVGTLTSIGFSISNNTDRDTMSVIKVEAPNQVTDSRLGLPNPDSICKTCGSKDRKVCEGHFGVINFQYSIINPYFLKEIAALLNKICPGCKYIRKKQFQITEDQPERCRYCTSNTGYPLMKFRVTTKEVFRRSGIVVEVNEESLMKLKKRGVLALPPDYWSFVPQDSNIDESCLKPTRRILTHAQVYALLSGIDQRLIKKDIPMFDSLALTSFPVTPNGYRVTEIVHQFNGARLVFDERTRIYRKLVGFEGNTLELSSRVIECMQYSRLFSENVSSSQDSANPYQKKSDTPKLCGLRFMKDVLLGKRSDHTFRTVVVGDPSLKLHEIGIPERIAKRLQVSEHLNNWNNERLVTFCSPNLFDNKEVHVRRGDRLVAIRVSDLQTGDKIFRNLMDGDTVLMNRPPSIHQHSLIAMTVRVLPTTSVVSLNPICCLPFRGDFDGDCLHGYVPQSIQAKVELDELVALDKQLINRQNGRNLLSLGQDSLTAAYLVNVEKNCYLNRAQMQQLQMYCPFQLPPPAIIKASPSSTEPQWTGMQLFGMLFPPGFDYTYPLNDVVVSNGELLSFSEGSAWLRDGEGNFIQGLIKHDKRKVLDIIYSAQEMLSQWLLMRGLSVSLADLYLSSDPQSRKNLTEEISYGLREAEQVCNKQQLMVESWRDFLAVNGEDEGEDSVARDLARFCYERQKSATLSKIAVSAFKDAYRDVQALAYRYGEQSNSFLIMSKAGSKGNIGKLVQHSMCIGLQNSAVSLSYGFPRELTCASWNDPNSPLRGAKGEDSTATESYVPYGVIENSFLTGLNPLESFVHSVTSRDSSFSGNADLPGTLSRRLMFFMRDIYAAYDGTVRNSFGNQLVQFTYETDGPVEDITGEALGSLSACALSEAAYSALDQPISLLETSPLLNLKNVLECGSKKGQREQTMTLYLSETLSKKKHGFEYGSLEIKNHLEKLSFSEIVSTSMIIFSPSTNTKVPLSPWVCHFHISEKVLKRKQLNVESVVSSLNEQYKSRNRELKLDIVDLDIQSTNHCSSDDKAMKDDSFCITVTVIEASKHSVLELDAIRLVLIPFLLDSPVKGSQEIKKVDILWTDRPKAPKRNGDHLAGELYLRVTMYGDRGKRNCWTALLETCLPIMDMIDWSRSHPDNIRQCCSVYGIDAGRSIFVANLESAVSDTGKTILKEHLLLVADSLSVTGEFVALNAKGWSKQRQVESTPAPFTQACFSSPSQCFLKAAKEGVRDDLQGSIDALAWGKVPGFGTGDQFEIIISPKVHGFTTPVNVYDLLSSTPPKTNSAPKSDKVTVQPFDLLGTAFLKGIKVLDGKGISMSRLRTIFTWENIEKLSQSLKRILTSYEINDPLNGRDEELVMMVLHLHPNSADKIGPGLKGIRVAKSKHGDSRCFEVVRIDGTFEDFSYHKCVLGATKIIAPKKVNLYKSKYLKNGTHQPGRLSENPQTVK

SEQ ID NO: 43 - protein, 1469 aa, Cucumis sativus
MEDEQDGELPIPSGLLTGINFSVSNQQDIENIAVITVDAANEVSDPKLGLPNPSYQCTTCGASSLKFCEGHFGVIKFPYTIIHPYFLSEVAQVLNKVCPGCKSVRQELWGKVEDPTSDYNRPKGCRYCFGSLKDWYPPMRFKLSTTDMFKKSMIMVEVKENMSKKYQKRVAKGGLPSDYWDFIPKDEQQEESYCRPNRKILTHAQVHYLLKDIDPKFLKKFVPAIDSLFLNSFPVTPNSHRVTEMAHSFSNGQRLIFDERTRAYKKVVDFRGTANELGSRVLDCLKISKAIYNIFVFCLNHVNYYQKKIKDTATSSSGLRWIKDVVLGKRSDHCFRMVVVGDPNIELSEIGIPCHVAERLQISEHLSSWNMKKLSTSCYLHLVEKGEIYVRREGRLVRVRNVLELNMGDTIYRPLADGDIVLVNRPPSIHQHSLIALSVKLLPVSAVLSLNPLCCSPFRGDFDGDCLHGYVPQSLEARVEVRELVSLDKQLTNGQSGRNLLSLSHDSLTAAHLILEDGVSLNLFQMQQLQMLTLHQLLPPAIVKSPLLRNCAWTGKQLFSILLPPDFDYSSPSHNVFIEKGELISSEGSYWLRDSGRNLFQALIEHCEGKTLDYLRDAQGVLCEWLSTRGLSVSLSDLYLSVDSYSHENMMDDIFCGLQEAEETCNLKQLMVDSHKEILIGNDEDNQHLLSIAVERLIYEKQKSAALNQASVDAFKKVFRDIQNLVYKYSGKDNSLLTMFKAGSKGNLMKLVQHSMCLGLQHSLVTLSFSLPHKLSCAAWNSQKMPRYIQKDGLPDRTQSFIPYAVVENSFLSGLNPFECFAHSVTNRDSSFSDNAEVPGTLTRKLTFLMRDIYTAYDGTVRNAYGNQLVQFCYDIDRPTSESESENNNRDRGIGGHPVGSLAACAISEAAYSALDQPISLLEASPLLNLKRVLECGSKRNSTKQTFSLFLSEKLSKRSYGFEYGALGVKNHLERVMFKDIVSSVMIIFSPLPSRKKHFSPWVCHFHVCKEILKKRRLKMNSVIHSLNMRCDSMRQEGRMNLPSLQIITQDCPLADSLTEDGDTVCLTVTIAENTKNSFLQLDFIQDLLIHFLLGTVIRGFTEIDRVDITWNDRPKVPKPRCSHGELYLRVTMSGEGNSRFWATLMNNCLPIMDLIDWTRSHPDNTHSLCLAYGIDSGWKYFLNSLESATLDVGKTIRLEHLLLVSNSLSATGEFVGLNVKGLTHQREHALVKTPFMQACFSSPGACMIKAAKAGIKDNLSGSLDALAWGRMPSLGTGGQFDILYSGKGHELNKPVDVYNLLGGQSTCEKQNTKIESLDKNTISEKYSAQLMLKNGGSTIKGLKRLDSVSKSILRKFLTLNDIQKLSFALRTILHKYSLNERLNEVDKSTLMMALYFHPHRDEKIGVGAQDIKVGSHSKYQNTRCFVLIRSDGTTEDFSYHKCVLGALEIIAPHRVKGYQSKWMQEKFE

SEQ ID NO: 44 - protein, 1458 aa, Vitis vinifera
MDNDFLEEQQVPSGLLIGIKFDVSTEEDMEKISVMKIDAVNEITDPKLGVPNPSCQCSTCGAKDTKKCEGHFGVIKFPFTILHPYFLTEVVQILNKICPGCKSTRQGQWVKGADSGSRRLRSKGCKYCAANSNDWYPTMKFKVSSKDLFRKTAIIVEMNEKLPKKLQKKSFRPVLPLDYWDFIPKDPQQEENCLNPNRRVLSHAQVHYLLKDIDPGFIKEFVSRMDSFFLNCLPVTPNNHRVTEITHALSNGQTLIFDQHSRAYKKLVDFRGTANELSCRVLDCLKTSKLRSEKSTSKDSASKMSGLKWIKEVLLGKRTNHSFRMIVVGDPKLRLSEIGIPCHIAEELLISEHLNSWNWEKVTNGCNLRLLEKGQTYVRRKGTLAPVRRMNDFQAGDIIYRPLTDGDIVLINRPPSIHQHSVIALSVKVLPLNSVVSINPLCCSPFRGDFDGDCLHGYIPQSVDSRVELSELVALNRQLINRQSGRNLLSLSQDSLSAAHLVMEDGVLLNLFQMQQLEMFCPYQLQSPAIIKAPLLDTQVWTGKQLFSMLLPPGFNYVFPLNGVRISDGELISSSDGSAWLRDIDGNLFSSLVKDCQGKALDFLYAAQEVLCEWLSMRGLSVSLSDIYLSSDSISRKNMIDEVFCGLLVAEQTCHFKQLLVDSSQNFLIGSGENNQNGVVPDVQSLWYERQGSAALCQSSVCAFKQKFRDIQNLVYQYANKDNSLLAMLKAGSKGNLLKLVQQGLCLGLQHSLVPLSFKIPHQLSCAAWNKQKVPGLIQNDTSEYAESYIPYAVVENSFLMGLNPLECFVHSVTSRDSSFSDNADLPGTLTRRLMFFMRDLYIAYDGTVRNAYGNQLVQFSYNIEHTSTPSDGINEDTCAYDMGGQPVGSISACAISEAAYSALDQPISLLEPSPLLNLKRVLECGLRKSTADRTVSLFLSKKLEKRKHGFEYGALEVKNHLEKLLFSDIVSTVMIVFSPQNGSKTHFSPWVCHFHVCEEIAKKRSLKPHSIIDALYMKCNSARAESKINLPDLQITSKDCFVDMEKEDSDCFCITVSIVNSKKSCIQLDTVRDLVIPFLLGAVVKGLLDVKKVDILWNDNPDSDVLKSSSGRLYLRVYVSGDCGKKNFWGVLMDACLQIMDMIDWERSHPDNIHDIFVVYGIDAGWKYFLNSLKSAISDIGKTVLPEHLLLVASCLSATGEFVGLNAKGMARQKELTSISSPFMQGCFSSPGSCFIKAGKRAVADNLHGSLDALAWGKIPSVGSGGHFDILYSAKGHELARPEDIYKLLGSQTSCHEQNLKVKVPITCYQTTTKCGAQLVYANGDSASKGCKSLEKISKSVLRSFLSLNDIQKLSRRLKFILQKYPINHQLSEIDKTTLMMALYFHPRRDEKIGPGAQNIKVRYHSKYHNTRCFSLVRTDGTEEDFSYHKCVHGALEIIDPRRARSYQSRWLPYSEV

SEQ ID NO: 45 - protein, 1519 aa, Medicago truncatula
MDDEDLATVHKVPSALIKAIKFEVLTGEDIEKISALEINAPGQVTCSDLGLPNSSYGCTTCGSKDRKSCEGHFGAIKFPFTILHPYFMAEIAEILQKICPACKSIRQEIRVKRAKSLLGYNNQPKGCKYCCGNGMGRYPAMKFRVSSNDFFRRTAIIVEVNDISLNKKRNLGRGLPADYWDFILGDVQQEENHVNRKVLSPVQVENLLSGVDPNFIEKFIPSMDLVGLSCFLVAPNCHRVTEVPHRLSGGYPLSFDNRTRACKKLVDFRGTANELSSRVLDCLRFSKINPDRTPVNIFTELQQRKVGENACNSSGLRWMKDVVLGKRNDCTFRTVVVGDPDLELSEIGIPCQIAEALQVSEYVNRQNRQNLLYCCELRLLEKGQINVRRNGNPVVLYKKEDLQIGDIFYRPLVDGDKVLINRPPSIHQHSMIALTVRVLPISSVVSINPICCSPLRGDFDGDCLHGYIPQSVGARVELNELVALDRQLINGQSGGNLLSLSQDSLTAAHLLLEDGVGFNIYQVQQLEMLCNKELTSPAIFKAPSSNTPFWSGKQLFSMLLPSKFDYAFPSNDVFVKDGELISCSESSGWLRDSENNVFQSLVEHFQGKILDVLHGAQKALCEWLSMTGFSVSLSDLYLSSDSYARKNMMEEISYGLRVAEQACDFNQLLVDHYSDFLSASPEENEKFVTVDVDRLNHERQISAAQSQASVDAFRHVFRNIQSLADKHACKDNSFLAMFKAGSKGNLLKLVQHSMCLGLQHSLVRLSYRIPRELSCAGWNSQKGLHSMEMSSDTLEPKQSYIAHAVVESSFLTGLNPLECFVHSVTNRDSSFSDNADLPGTLTRRLMFFMRDMYDAYDGTVRNLYGNQLIQFSYDAEEDSSCDSYFREDIIGGEPVGALSACAVSEAAYSALSQPISLLEASPLLNLKNVLECGSRKKGGDQTVSLFLSEKIGKQRNGFEYAALEVKNYLERYMFSNIVSTVMIIFTPQHCSQVKYSPWVCHFHLDKENVTRRKLEVHSIIDSLYQQYDSFRRESKVILPSLKISSKKWCVDYKANEGGETSVGNEKDGEDCITVAVVEDSKNSVQLDSVRKSLIPFLLQTAIKGFLEIKKVDILWKDLPKVTKSYNGSAGELYLRVTMSSGNDNGTFWGRLINHCHRIMPLIDWTRSHPDNIHHFCSAFGIDAGWQHYFHNLSSATSDTGKSILPKHLRLVANSLSASGEFVGLNAKGMARQRKHASVSSPFVQACFSNPGSSFLKAAKSGIVDNLQGNLDALAWGNCLPMGTGGQFDIIYSEKVEEINKSVDVYGLLETSFNQMDQEINIPQSRKYSSGKCSSDFRSKNGGYTPKEPKQWKSVLRNFMTANDIQRLTFDARVILNKYQIDETLSETDKLTIMKVLHFHPRRDEKFGSGPQNIKVGWHPEFTDSRCFFIIRKDGSVEDFSYRKCILGALDIIDPKKSKIQRNRWSGNGDMEAKKWSGNGDMEAKKWSGSYDKEAKKWSQSYDKEAKKWSGNDDVEVTSI

SEQ ID NO: 46 - protein, 1475 aa, Ricinus communis
MEADLFEERQQLPSALLTAITFGVSTEAEKEKLSVLTIDTVSEVTDSKLGLPNPTNQCSTCGSKDLKSCEGHFGVIKFPFTILHPYYLSEVVRILNQVCPKCKSIRKESKVRCLNHLNPKLPVLLILLCWYPAMKFSVSSEEIFRKNVIIAKFSERPTNKSQKRGFKKKLAADYWDIIPKDEQQEENITRPNQRVLSHAQVIHLLENIDPNFIRKFVLKRDSIFLNCFSVTPNCHRVTEVTHAFSNGQRLVFDDRTRAYKKMVDFRGIAKELSFRVLDCLKTSKINPDKSVNNDDYMALQRKMNDSSSSSSGLRWIKDVVLGKRNDNSFRMVVVGDPNIKFSEIGIPCPIAERLQISEHLTTWNWDKLNTCCEVRLLEKGDMHVRREGKLVRVRRTKELRIGDIIYRPLNDGDTVLINRPPSIHQHSLIALSVKVLPATSVLAINPLICAPFRGDFDGDCLHGYVPQSVDTRVELRELVALDKQLINVQNGRNLLSFSQDSLVAAHLVMEDGVLLSLQQMQQLQMFCPHQLFSPAVRKAPSLNGCAWTGKQLISMLLPRGFDHECPSSDVYIRDGELISSEGSFWLRDTDGNLFQSLIKQCQDQVLDFLYIAQEVLCEWLSMRGLSVSLSDLYLCPDSDSRENMMDEVLFGLQDAKGTCNMKQFMVDSCRDFLASIDEDEQYSVNFDVEHLCHEKQRSAALSQASVDAFKHVFRDIQTLGYKYASKDNALMAMFKSGSKGNLLKVVQHSMCLGLQHSLVPLSFRMPLQLSCDAWNKQKAENAVECARSYIPSAVVEGCFLTGLNPLECFVHSVTSRESSFSDNADLPGTLTRRLMFFMRDVHAAYDGSVRSAYGNQLIQFSYNIDEGRSAETYGTAKIVDNYDGMAGKPVGSLAACSISEAAYSALDQPISLLEKSPLLNLKNVLECGLKKSNAHKSMSLFLSEKLGRRRHGFEYGALKVQDHLERLLFSDIVSVSRIIFSSQSESKTCFSPWVCHFHVYKEIMKKRNLNVDSIINILNGRCKSNTNLPNVQISCKSCSIADNHREKEETLCITVTIVERSKNSSTRLATIQDLMIPFLLETVLKGLMEINKVDILWKDWPRISKTHNQPYGELYLRVSMSADSEKTRLWNLLMDYCLPIMDMIDWTCSRPDNVRDFSLAYGIDAGWKFFLQRLESAISDVGKSVLPEHMLLVANCLSVTGEFVGLNAKGWKRQREDASVSSPFVQACFSSPGNCFIKAAKAGVKDDLQGSLDALAWGKVPSVGTGQFDIVYSGKVKLLLFLLVKRVKLKTPPSFVVLTVFLETPLINLLVWYSVDQQLNEADKCTLTMALYFHPRKEEKIGSGFKDIKVVKHPEYQDSRCFSLVRSDGTIEDFSYRKCVYGALEIIAPHKARSQIEFFQNSDVVAIIGRITYKLFVGQSEVKELPWEVVHACGLGKHSNRVISMLCYVQGSCKVDLALCNGLGRRLALVTANRA

SEQ ID NO: 47 - protein, 1458 aa, Glycine max
MDDDLLQRNKTPSVVIKAIKFDVLTEEDIENISVLEINAAGQVTGSNLGLPNASDECATCGTKDKKFCEGHFGVIKFPTPILHPYFMLEIAHILNKICPVCKSIRHKSKGARLIYGTKRSNDCNYCSVYPSMQFRVSSNDLFRRTAIIVEVKASKKTLGTEIPADFWNFIPCDAQQEENYVNRRVLSPVQVNYLLNDVDPDFIEKYIPRKNLLCLNCFPVTPNCHRVTEVPYAISSGSRLSFDDRTRSCKKLVDFRGTANELSSRVLDCLRISKLNPDKTPNSIFADIQQRKIGENAFNSSGLRWIKDVVLGKRNDSSFRTVVVGDPDLELSEIGIPCHIAESLQVSEYVNRQNREKLLYCCELHLLEKGKINVCRKGSIVHLYKKEDLQIGDKFYRPLADGDKVLINRPPSIHQHSMISLTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISNKRLIPPAVVKAPSSNSSLWNGKQLFSMLLPYDFDYSFPSDGVVVSDGELVSSSEASGWLRDSDYNVFQSLVEHYQGKTLNFLYAAQKVLCEWLSMTGFSVSLSDLYLSSDSYARENMIEEIFYGLQDAERACNFKQLLLDYYCDFLSGSLQESENAITVNADRLNYERQISASLSQASVDAFRQVFRNIQSLADKYACKGNSFLAMFKAGSKGNLLKLVQHSMCLGMQNSLVRLSYRLPRHLSCADWNSQKWVDSIQMSSGTLESVQSYIPYAVVESSFLTGLNPLECFVHSVTNRDSSFSDHADLPGTLTRRLMFFMRDLYDAYDGTVRNLYGNQLIQFSYDIEEDSSCNKGFQQYALGGESVGAISACAISEAAYSALGQPVSLLETSPLLNLKNVLECGSRKRNGDQTVSLFLSEKLGKQRHGFEYAALEVKNYLERLLFSNIVSKVMIIFTPHDSRSQEKYSPWVCHFHLDKEIVTRRKLKVHSIIDSLYQRYYSQRKDSKVCFTNLKISSSRKCSADSMVKEGEDTSIDKEEGDDCIMVTIVENSKNPIQLDSVRDLVIPFLLGTAIQGFLDVKKVDILWNNQSKVTNSRNGFSGELYLRVTLSSEGSRGRFWGVLLKLCHKIMHIIDWTRSHTDNINHFSSAYGIDAGWQYFFNSLACATSDTGKSILPKHLCLVANSLSCSGEFVGLNAKGMALQRKHASVSSPFVQACFANPGSCFIKAAKSGATDNLQGSLDGLAWGNCLSMGTSGMFDVIYSEKGHQVAKSVDVYELLEASFDKPNNKIGTHLHKYSSDKCGSEFRHKNGYALKEGKQWKTILRNFVTVNDIQKLTFASRCILNKYSIDELLSESDRSTMLRVLNFHPHKSEKFGIGPQDIKVGWHPKYKDSRCFHIIRTDGTVEDFSYRKCILGALDIVDPKKSKIQEKKWSGHGDT

SEQ ID NO: 48 - protein, 1444 aa, Zea mays
MELHREPPEAILNAIKFDLMTSTDMEKLSSMSIIEVSDVTSPKLGLPNGSLQCETCGSQRGRDCDGHFGVTKLAATVHNPYFIDDVVHFLNRICPGCLSPREGIDTKRLEREKVQATCKYCSKDGSKLYPSIVFKTLSSPRVLLFKSKLHRNASVMERISIVAEAADRMPNRSKGKGSLEGLPLDFWDFVPSENKQVQSNMTKIILSPYQVFYMLKKSDPELIKQFVSRRELLFLSCLPVTPNCHRVVEIGYGLPDGRLTFDDRTKAYKRMVDVSRRIDDYRQHPHFSVLASSLVSSRVSECLKSSKLYSKKADGETSTDTYGMKWLKDVVLSKRSDNVFRSIMVGDPKIKLWEIGIPEDLSSSLVVSEHVSSYNFQSTNLKCNLHLLAKQELFIRRNGKLMFLRKADQLEIGDIAYRPLQDGDIILINRPPSVHQHSLIALSAKILPIHSVVSINPLCCTPFAGDFDGDCLHGYIPQSIRSRVELEELVSLHNQLLNMQDGRNLVSLTHDSLAAAHLLTSTDVFLKKSELQQLQMLCLSVSTPAPAVIKSMNFQGSLWTGKQLFSMLLPSGMNFSCDTELHIMDSEVLTCSLGSSWLQNNTSGLFSVMFKQYGCKALDFLSSAQEVLCEFLTMRGLSVSLSDLYMFSDHYSRRKLAEGVKLALYEAEEAFRVKKILLDPINIPVLKCHDETEDVTYRQSDCIQSNPSVIRSSIMAFKDVFRDLLKMVQQHVSNDNSMMVMINAGSKGSMLKYAQQTACIGLQLPASKFPFRIPSQLSCISWNGQKSLNYEAESTSERVGGQNLYAVIKNSFIEGLNPLECLLHAISGRANFFSENADVPGTLTRKLMYHLRDIHVAYDGTVRSSYGQQIVQFSYDSVDDLVDKLGAPVGCRAACSISEAAYGALEHPVNGLEDSPLMNLQEVFKCHKATNSGDHIGLLFLSRHLKKYRYGLEYASLEVKNHLERVNFSDLVETIMIIYDGHDKIRNEGMWTTHFHINKAMMKKKRLGLRFVVDELAKEYDTTRDQLNNAIPSIRISRRKCLVGDEGVKSSSCCIAVVAHAERNSISQLDTIKTRVIPSILDTLLKGFLEFKDVEIQCPHDGELLVKVCMSEHCKGGRFWPTLQNACIPVMELIDWELSQPSNVSDIFCSYGIDSAWKYFVESLKSATTDTGRNIRREHLLVIADSLSVTGQFHALSSQGLKQQRTRLSISSPFSEACFSRPAQSFINAAKQCSVDNLCGSLDAVAWGKEPFNGTSGPFEIMHSGKPHEPEQNESIYDFLCSSKVRNFEKNHLDTRRQSTENASICRLACKSSKGSTTVNGVAITIDQDFLHAKVSIWDNIIDMRTSLQNMLREYPLNGYVAEPDKSQLIEALKFHSRGAEKIGVGVREIKIGLNPSHPGTRCFILLRNDDTTEDFSYHKCVQGAADSISPQLGSYLKKLYYRA

SEQ ID NO: 49 - protein, 1203 aa, S. Bicolor
MELHRELPEATLNAIKFDLMTSTDMEKLSSMSVIEVSDVTSPKLGLPNASPQCETCGSKSGRDCDGHFGVTKLAATVHNPYFIDDVVHFLNQICPGCLSPREGINMKKDGSKLYPSVIFKTLSSPRVLLSKSKLHRSPSVMERISIVAEAAERVSNRSKGKGLLEGLPQDYWDFVPSENKQVQSNMTKIILSPYQVFHMLKKSDPELIKQFVSRRELLFLSCLPVTPNCHRVVEIGYGLSDGRVTFLYSKKTDGETSTDPSGMKWLKDAVLSKRSDNAFRSTMVGDPKIKLWEIGIPEDLASNLVVSDHVNSYNFENINLKCNLHLLTKEELFIRRNGKLMFLRKADQLEIGDIAYRPLQDGDLILINRPPSVHQHSLIAFSAKILPIHSVVSINPLCCTPFLGDFDGMKFSCDRMLHILNGEVLTCSLGSSWLQNNTSGLFSVMFKQYGCKALDFLSSAQEVLCEFLTMRGLSVSLSDMFSDHYSRRKLTEGVKLALDEAEEAFRIKQILLDPINIPVLKCQDETEDVTYRQSDCIQNNPSVIRSSIMAFKDVFSDLLKMVQQHVSNDNSMMVMINAGSKGSMLKYAQQTACVGLQLPASKFPFRVPSQLSCIRWNRQKSLNYEAEGTNERVGGQNLYAVIRNSFIEGLNPLECLLHAISGRANFFSENADVPGTLTRKLMYHLRDIHVAYDGTVRSSYGQQIVQFSYDSADDPEVFKCHKATNSGDHIGLLFLSRHLKKYRYGLEYASLEVKNHLEQEMMKKKRLGLRFVIEELTKEYNATRDQLKNAIPSICISRRKCVVGDEGVKISACCIAVVALAEPNSMSQLDTIKKRVIPIILDTLLKGFLEFKDVEIQCQHDGELLVKVCMSHHCKGGRFWATLQNACIPVMELIDWELSRPSNVADIFCSYGIDSAWKYFVESLKSATTDIGRNIRREHLLVIADSMSVTGQFHAISSHGLKQQRTRLSISSPFSEACFSRPAQSFIDAAKQCSVDNLCGSLDAIAWGKEPFNGTSGPFEIMHSGKPHEPEQDESIYDFLRSPKVQNVEKNHLDTRRQSTENASICRLACKSKGSATVNGVAITSDQDFLHAKVSIWDNIIDMRASLQNMLREYPLNGYVMEPDKSKLIEALKFHPRGAEKIGVGVREIKVGLNPNHPGTRCFILLRNDDTTEDFSYHKCVHGAANSISPQLGSYLKKLYHRA

SEQ ID NO: 50 - protein, 1623 aa, O.sativa
MLLEPELSPGSLGTRTRGEGWMEEPSLEVNNPVAELNAIKFSLMTSSDMEKLSSATIIEMCDVTNAKLGLPNGAPQCATCGSRSIRDCDGKKKLTGKLLGHFGVIKLAATVHNSYFIEEVVQLLNQICPGCLTLKQNGDTKKADGTTIQGTCKYCSKDGSKLYPSIIFKMLTSPRVTLSRSKLHRNTSVMDKMSIIAEVAGGVAHKSKNKAPHETLPQDFWDFIPDDNQPPIFNVTKKILSPYQVFHMLKKLDPELINQDDRTKAYKRMVDLYSKKSDDESSASTDTYGTKWLKDIILSKRSDNAFRSIMVGDPKINLNEIGIPMGLALNLVVSEQVSSYNFETINLKCNLHLLTKEVLLVRRNGNLIFVRKANQLEIGDIAYRLLQDGDLVLVNRPPSVHQHSLIALSAKLLSTQSAVSINPLCCDPFKGDFDGDCLHGYIPQCLQSRIELEELVGLSGQLLNQQDGRSLVSLTHDSLAAAHQLTNADVFLEKAEFQQLQMLSSSISLTPMPSVFKSTNSQGPLWTGKQLFGMLLPYGMNISFDQKLHIKDSEVLTCSSGSFWLQNNTSSLFSVMFKEYGCKALEFLSSTQDVLCEFLTMWGLSVSLSDLYLFSDHYSRRKLSEEVHLALDEAEEAFQIKQILLNSVSIPNLKYYDGGDDRSNTDEQSGFTQVSLPIIRSSMTSFKSVFNDLLKMVQQYVSKDNSMMTMINSGSKGSVLKFVQQTACVGLQLPASKFPFRIPSQLSCVSWNRHKSLNCEITDGTSECVGGQDMYAVVRNSFLDGLNPLECLLHAISGRANFFSENADVPGTLTRKLMYHLRDTYVAYDGTVRSSYGQQIVRFSYDTADGMYSDHDLEGEPGAPVGSWAACSISEAAYGALDHPVNSLEDSPLMNLQEVLKCHKGTNSLDHTGLLFLSKHLRKYRYGFEYASLEVKDHLERVDFSDMVDTVIILYGGSDMQKTKGNPWITHFHLNQETMKIKRLGLEFIVREIIDQYNTLRKQLNNAIPSVSISNSETLHLKMENKSGKLGKNLGTGNECVKNQTCCVTMVVQVEINSMSQLDVIKERVIPSILATLLKGFLEFKNVKVQCQEDNELVLKVGMSEHCKSGKFWATLQNACIPIMELIDWERSRPERVYDNFCSYGIDSAWKFFVESLRSTTDAIGRNIHRQHLLVVADCLSRPAHSFINAAKRDSVDNLSGTLDAIAWGKEPCAGSSGPFKILYSGKSHETKQNEHIYDFLHNPEVQALEKNVMDTYRKRTEKTSKRRSALNSEGNATINGGAISFNQKFLNAKVGIWENIIDMRTSLQNMLREYTLNEVVTEQDKSCLMEALKFHPRGYDKIGVGIREIKIGVNPGHPSSRCFIVLRNDDTTADFSYNNRFPCRYLHSELPEAPPERLRPSHRPSAAACGGGGGGNCVVSSTREKPCKFFLSGDCRYGDECRCYLHAGSINDGFSLLTPLRGHQKEPLLFVGIPDAVKIWDTGAEMSLSEPTGEYMHWRLAMGCSSLQCNYTSLGCYGKLETGSLAVTYTHNEDHGALALAGMQDAQLNPILLWSTNYNIVHLYELPSMEEQVRKAVFLNRETFGSQFALAISRIPYSVVEEYTSTGLEELFADVGTWKKQN

SEQ ID NO: 51 - protein, 1470 aa, B. distachyon
MSEWTDGPNNEMDVPMAELKALKFDLLSSADIETLSSANIIEASDVTSAKLGLPNAAPQCVTCGSQNVRDCDGHSGVIKLPATVYSPYFLEQLVQFLNQICPGCWTPKQNRDTKRSDAATIQEPCKYCSKDGLYPSVIFKVLTSPRITLSKSKLQRNTSVMDKVSVTAEVINMSKNKSSLEVLPHDYWNFVPHNQPPQPNTTKILLSPYQVFHILKQVDLELITKFAPRRELLFLSCLPVTPNRHRVAEMPYRFSDGPSLAYDDRTKAYKRTVDASKKIDDYRQHPQFSVLASSFVTSRVMECLQSSKLYSKKTDKESSTDSYGTSVKKNDSYGTKWLKDAILSKRSDYAFRSIMVGDPKIRLHEIGIPMDLADLFVPEHVSIYNFKSINLKCNLHLLAKELLIARRNGKLIYVRKENQLEIGDIVYRPLQDGDLILVNRPPSVHQHSLIALSAKLLPVQSVVAINPLNCAPLSGDFDGDCLHGYVPQSIGSRVELGELVSLSHQLLNMQDGRSLVSLTHDSLAAAHLLTSSGVLLNKTEFQQLQMLCVSLSPTPVPSVIKSINPQGPLWTGKQLFGMLLPSGMNFSPDPKLHIKDSEVLACSGGSFWLQNNTSGLFSVLFKQYGGEALEFLSSAQDMLCEFLTMRGLSVSLSDIYLFSDHYSRRKFAEEVNLALDEAEEAFRVTQILLSPNFIPHLKCYDDCDDLSDSYEQSDFVQSNLPIIKSSIMAFKSVFSDLLKMVQQHTPKDNSMMAMINAGSKGSMLKFVQQAACVGLQLPAGKFPFRIPSELTCASWNRHKSLDCDISEGARKRLGGQNSHAVIRNSFIEGLNPLECLLHSISGRANFFSENADVPGTLTKNLMYHLRDIYVAYDGTVRSSYGQQIVQFTYDTAEDIYTDCGQEGEFGAPVGSWAACSISEAAYGALDHPVNVIEDSPLMNLQEVLKCQKGTNSLDHFGLLFLSKNLKKYRYGFEYASLYVQNYLEPMDFSELVNTVMIQYDGGGVQKTKGSPWITHFHISKEMMKRKRLGLRLLVEDLTEHYNAKRDQLNNVIPKVYISKCKCSDDDDCINNQTCCITVVAQDESNSTSTSQLDDLKKRAIPVLLATPVKGFLEFKDVEIQCQRDNELVVKVNMSKHCKSGIFWTTLKKACIGIMGLIDWERSRPGSVYDIFCPCGIDSAWKYFVESLRSKTDDIGRNIHREHLLVVADTLSVSGQFHGLSSQGLKQQRTQLSTSSPFSEACFSRPADTFIKAAKQCSVDNLCGNIDALAWGKEPPAGTSGPFKIMYAGKPHEPVQNENIYGFLHNPEVWGPEKNHMETDSTRTKNASERWSSGNATFNGGTISVEQNYLGAKVGVWDSIIDMRTCLQNMLREYQLDEYVVELDKSRVIEALRFHPRGREKIGVGIRDIKIGQHPSHPGTRCFILVRNDDTTEDVSYKKCVQGAADSISPQLGSHMEKILQTRSFCRDSWR

SEQ ID NO: 52 - protein, 1109 aa, Populus trichocarpa
MLKDVDPNFIKLSILKTDTIFLNCFPVTPNSHRVTEVTHAFSNGQRLIFVRTVSSTTSFVLVVLDCMSQQLGKLPKLFSCAHCACRMNGLGLTKKWLISEGWIKDVVLGKRNDHSFRMVIVGDPHLQLHEIGIPCHIAERLQVSESLTAWNWEKLNACFEKSRFEKGDMHVRREGNLVRVRHMKELRLGDIIYRPLNDGDTVLINRPPSIHQHSLIALSVKVLPVPSVLAINPLCCPPFRADFDGDCLHGYVPQSVDTRVELTELVSLDKQLTNWQSGRNLLSLSQDSLTAAHLVLEDDVFLSSFELQQLQMFRPERFLLPAVKAPSANALVWTGKQLISMLLPVGFDHDFPSCNVCIRDGDLVSSEGSFWLWDTDGNLFQSLVKHCHGQVLDFLYAAQRVLCEWLSMRGLSVSLSDLYLCPDSNSRKNMMDEIWYGLQDADYACNLKHLMVDSCRDFLTGNNEEDQCNVERLRFLSGCSEEDYCVMAFDGERLCYEKQRSAALSQSSVDAFRLVFRDIQSLVYKYASQDNSFLAMFKAGSKGNLLKLVQHSMCLGLQHALASLSFRIPHQLSCAGWNKQKADDATESAKRYIPHAVVEGSFLSGLNPIECFVHSVTSRDSSFSDNADLPGTLFRRMMFFMRDLHGAYDGTVRNAYGNQLVQFSYNIDDMDPSGSVDEINNSDGIAGRPVGPLAACAISEAAYSALDQPISLLEKSPLLNLKNVLECGLKRNSAHQTMSLFLSEKLGRQRHGFEYAALEVQNHLERLLFSDIVSFVRIIVFHLDEIMTYHYHLCPFLVLDSLQNLSKSARRSVVLSDLVIKCQTIQDLMIPFLLETVIKGFMEIQKVDILWNDKPKIPKSHNRLRGELFLRVHMSRGSDKTRLWNQLMDDCLSIMDLIDWARSHPDNIHECCLAYGIDAGWKFFLNNLQSAMSDVGKTVLPEHLLLVANCLSVTGEFVGLNAKGLKRQREHASVSTPFVQACFSNPGDCFIRAAKAGVVDDLQGSIDALAWGKVPAIGTGQFDIVYSGKFKSDAYHVDYLAKILEYQDTRCFSLVRTDGTIEDFSYRKCLHNALEIIAPQRAKRYCEKYLTSKVSATDNSGCTDLPLDN

SEQ ID NO: 53 - protein, 1444 aa, B. napus
MEEECEELQVPMGILKSIRFSISNNKDRKNMAVMDVEAANQVTDSRLGLPNPDSICRSCGSKDRKVCEGHFGVINLKYPVINPYFLKEIATLLNRICPGCKYMRKKQSQSSEDRPERCRYCTSNTGYPLMRFRVTTKEVFRRSGIVCEVSEDNLFKLSKRGLSSLPPDYWEFLPKDSNIDESCLKPSRRILTHAQVYALLCGIDERLIRKDIPMFDSLPLTSFPVTPNGHRVSEMVNQFTGARLIFDERTRIYKKLVGFEGNGLELSARVIECMQYSRLFSENMSPSQESANPYQKKSDTPKLCGLRFMKDVLLGKRSDHTLRTVVVGDPCLKLNEIGIPRRIAERLQVSENLNDWNRERLVTSCFHKLLERGETHVRRGGSLVAIRVIEDLQTGDSILRTLKDGDTVLMNRPPSIHQHSLIAMSVKVLPTTSVVSLNPICCLPFRGDFDGDCLHGYVPQSIQAKVELDELVALDKQLVNRQNGRNLLSLGQDSLTAAYLVSVETNCFLNRAQMQQLQMYCPFELPPPAIIKASSSEAQWTGMQLFGMLLPPGFEYTYPLNDVVVSNGGLLSSSDGSGWLRDGEGNFIQGLLKEHKEKVLDIMYSTQEMFSQELQMRGLSVSLADLYLASDPESRRNLTEEISYGLQEAEQVCNKQQLMVESRRDFLAGNVEDMAADLDRFCYERQRSATLSKLAVNAFKDAYRDVQSLAYRYAAESNSFLIMSKAGSKGNMGKLAQHSMCIGLQNSSVALSFGFPRQLTCASWNDPNSPLRGAKRQDQTGHESFVPFAVIENSFLTGLNPLESFVHSVTSRDSSFSGNADIPGALNRKLMFFMRDIYAAYDGTVRNSFGNHLVQFHYETEEDITGEAVGSLSACALTEAAYSALDQPISLLETSPLLNLKNVLECGSKKGLKEQTMSLYLSETLSKKKHGFEFGALDIKSHLEKLSFSEIVSTSMIIFSPRTNTKMPMSSWVCHFHISKKVLKQKQLDVESVVSSLNKQYANRKKELKLDVIDLEIQSTNHCSWDDKSMEDDRFCITVTVLEASTHGSLELDAIRLVLIPFLLDSPVKGYGEIKKVEILWADRPKAPKRNKKHMAGELFVKVTMHGVRGKKNIWSALLETCLPIMDMIDWTRSHPDNIRQCCSVYGIDAGRSIFLADLESAVADTGKGMLREHLLLVADCLSVTGEFVALNPKGWSKQRQAESTPAPFTQACFSSPSQCFLKAAKEGVTDELQGSIDALAWGKVPSFGTGDQFEIIISPKDHGFSSTPVDVYDFLSSTATLPKRKASSLPKSDNFTVQPFPLLDTALSKAVKTLDGKGLTRSQLRTIFTWDDIEKLSRSLKRILYNYEIDATLNERDERLLMMALLFHPNRDEKLGPGFRGIKVANSKHGNARCFEVVRTDGTTEDFSYHKCVLGATEIIAPKRVNFYKAKYLRNGTVQAGAI

SEQ ID NO: 54 - protein, 1976 aa, Arabidopsis thaliana
MEEESTSEILDGEIVGITFALASHHEICIQSISESAINHPSQLTNAFLGLPLEFGKCESCGATEPDKCEGHFGYIQLPVPIYHPAHVNELKQMLSLLCLKCLKIKKAKGTSGGLADRLLGVCCEEASQISIKDRASDGASYLELKLPSRSRLQPGCWNFLERYGYRYGSDYTRPLLAREVKEILRRIPEESRKKLTAKGHIPQEGYILEYLPVPPNCLSVPEASDGFSTMSVDPSRIELKDVLKKVIAIKSSRSGETNFESHKAEASEMFRVVDTYLQVRGTAKAARNIDMRYGVSKISDSSSSKAWTEKMRTLFIRKGSGFSSRSVITGDAYRHVNEVGIPIEIAQRITFEERVSVHNRGYLQKLVDDKLCLSYTQGSTTYSLRDGSKGHTELKPGQVVHRRVMDGDVVFINRPPTTHKHSLQALRVYVHEDNTVKINPLMCSPLSADFDGDCVHLFYPQSLSAKAEVMELFSVEKQLLSSHTGQLILQMGSDSLLSLRVMLERVFLDKATAQQLAMYGSLSLPPPALRKSSKSGPAWTVFQILQLAFPERLSCKGDRFLVDGSDLLKFDFGVDAMGSIINEIVTSIFLEKGPKETLGFFDSLQPLLMESLFAEGFSLSLEDLSMSRADMDVIHNLIIREISPMVSRLRLSYRDELQLENSIHKVKEVAANFMLKSYSIRNLIDIKSNSAITKLVQQTGFLGLQLSDKKKFYTKTLVEDMAIFCKRKYGRISSSGDFGIVKGCFFHGLDPYEEMAHSIAAREVIVRSSRGLAEPGTLFKNLMAVLRDIVITNDGTVRNTCSNSVIQFKYGVDSERGHQGLFEAGEPVGVLAATAMSNPAYKAVLDSSPNSNSSWELMKEVLLCKVNFQNTTNDRRVILYLNECHCGKRFCQENAACTVRNKLNKVSLKDTAVEFLVEYRKQPTISEIFGIDSCLHGHIHLNKTLLQDWNISMQDIHQKCEDVINSLGQKKKKKATDDFKRTSLSVSECCSFRDPCGSKGSDMPCLTFSYNATDPDLERTLDVLCNTVYPVLLEIVIKGDSRICSANIIWNSSDMTTWIRNRHASRRGEWVLDVTVEKSAVKQSGDAWRVVIDSCLSVLHLIDTKRSIPYSVKQVQELLGLSCAFEQAVQRLSASVRMVSKGVLKEHIILLANNMTCSGTMLGFNSGGYKALTRSLNIKAPFTEATLIAPRKCFEKAAEKCHTDSLSTVVGSCSWGKRVDVGTGSQFELLWNQKETGLDDKEETDVYSFLQMVISTTNADAFVSSPGFDVTEEEMAEWAESPERDSALGEPKFEDSADFQNLHDEGKPSGANWEKSSSWDNGCSGGSEWGVSKSTGGEANPESNWEKTTNVEKEDAWSSWNTRKDAQESSKSDSGGAWGIKTKDADADTTPNWETSPAPKDSIVPENNEPTSDVWGHKSVSDKSWDKKNWGTESAPAAWGSTDAAVWGSSDKKNSETESDAAAWGSRDKNNSDVGSGAGVLGPWNKKSSETESNGATWGSSDKTKSGAAAWNSWDKKNIETDSEPAAWGSQGKKNSETESGPAAWGAWDKKKSETEPGPAGWGMGDKKNSETELGPAAMGNWDKKKSDTKSGPAAWGSTDAAAWGSSDKNNSETESDAAAWGSRNKKTSEIESGAGAWGSWGQPSPTAEDKDTNEDDRNPWVSLKETKSREKDDKERSQWGNPAKKFPSSGGWSNGGGADWKGNRNHTPRPPRSEDNLAPMFTATRQRLDSFTSEEQELLSDVEPVMRTLRKIMHPSAYPDGDPISDDDKTFVLEKILNFHPQKETKLGSGVDFITVDKHTIFSDSRCFFVVSTDGAKQDFSYRKSLNNYLMKKYPDRAEEFIDKYFTKPRPSGNRDRNNQDATPPGEEQSQPPNQSIGNGGDDFQTQTQSQSPSQTRAQSPSQAQAQSPSQTQSQSQSQSQSQSQSQSQSQSQSQSQSQSQSQSQSPSQTQTQSPSQTQAQAQSPSSQSPSQTQT

SEQ ID NO: 55 - protein, 1947 aa, Arabidopsis lyrata
MEEESSSEILEGEIVGIKFALATHHEICIASISGSAINHPSQLTNSFLGLPLEFGKCESCGATEPDKCEGHFGYIQLPVPIYHPAHVNELKQMLSLLCLKCLKIKKAKSTSGGLADRLLGVCCEEASQISIRDRASDGASYLELKLPSRSRLQAGCWNFLERYGYRYGSDYTRPLLAREVKEILRRIPEETRKKLTAKGHIPQEGYILEYLPVPPNCLSVPDVSDGYSSMSVDPSRIELKDVLKKVIAIKSSRSGETNFESHKAEANDMFRVVDTYLQVRGTAKAARNIDMRYGVSKISDSSSSKAWTQKMRTLFIRKGSGFSSRSVITGDAYRHVNEVGIPIEIAQRITFEERVSVHNIGYLQKLVDDKLCLSYTQGSTTYSLRDGSKGHTVLKPGQVVHRRVIDGDVVFINRPPTTHKHSLQALRVYVHEDNTVKINPLMCSPLSADFDGDCVHLFYPQSLSAKAEVMELFSVEKQLLSSHTGQLILQMGCDSLLSLRVMLEGVFLDKATAQQLAMYGSLTLPPPALRKSSKSGPAWTVFQILQLAFPERLSCKGDRFMVDGSDLLKFDFGVDAMASIINEIVTSIFLEKGPKETLGFFDSLQPLLMESLFAEGFSVSLEDLSMSRADMDVIHNLIIREISPMVSRLRLSYRDELQLENSLHKVKEVAANFMLKSYSMRNLIDIKSNSAITKLVQQTGFLGLQLSDKKKFYTKTLVEDMALFCKRKYGRISSSGDFGIVKGCFFHGLDPYEEMAHSIAAREVIVRSSRGLAEPGTLFKNLMAVLRDIVITNDGTVRNTCSNSVVQFTYGVDSERGHQGLFEAGEPVGVLAATAMSNPAYKAVLDSTANSNSSWEQMKEVLLCKVNFQNTTNDRRVILYLNECHCGKRFCQENAAYTVRNKLKKVSLKDTAVEFLVEYRKQQTISEIFGIDSCLHGHIHLDKTLLQDWNISMQDILQKCEDVINSLGQKKKKKATDDFKRTSLSVSECCSFQDPCGRKDSDMPCLMFSYSATDPDLERTLDVLCNTIYPVLLETVIKGDPRICSANIIWNSSDMTTWIRNCHASRRGEWVLDVTVEKSAVKQSGDAWRVVIDACLSVLHLIDTKRSIPYSIKQVQELLGLSCAFEQAVQRLSASVRMVSKGVLKEHIILLANNMTCSGNMLGFNSGGYKALTRSLNIKAPFTEATLITPRRCFEKAAEKCHTDSLSTVVGSCSWGKRVDVGTGSQFELLWNQKETGLDDKEETDVYSFLQMVRSTTNADAYVSSPGFDVTEEEMAEWAESPERDSALGEPKFEDSAEFQNLHDEGKPSESNWEKSSSWDNGCSGGSEWGVSKNTGGEANPESNWEKTTNVEKEDAWSSWNTKKDAQESSKSDSGVAWGLKTKDDDADTTPNWETRPAQTDSIVPENNEPTSDVWGHKSGSDKSWDKKNGGTESAPAAWGSTDAAVWGSSDKKNSETESDAAAWGSRDKKNSEVGSGAGVLGPWNKKSSKTESDGATWGSSDKTKSGAAAWSSWDKKNMETDSEPAAWGSQSKNKPETESGPSTWGAWDTKKSETESGPAGWGIVDKKNSETESGPAAMGNWDKKKSNTESGPAAWGSTDAAVWGFSDKNNSETESDAAAWGSRDKKTSETESGAAAWGSWGQPTPTAANEDANEDDENPWVSLKETKSRDKDDKERIQWGNPAKKFPSSGGWSNGGGADWKGKRNHTPRPPRSEDNLAPMFTATRQRLDSFTSEEQELLSDVEPVMRTLRKIMHPSAYPDGDPISDDDKTFVLEKILNFHPQKETKLGSGVDFITVDKHTIFSDSRCFFVVSTDGAKQDFSYRKSLNNYLMMKYPDRAEEFIDKYFTKPRPSGNRDRNNQDATPPGEEQSQPPTQSIGNGGDDFNTQTQSPSQTQAQAQAQAQAQSPSQTQTQSPSPSQTQTQSPSQTQAQAQSPSQSPSQTQTYS

SEQ ID NO: 56 - protein, 1959 aa, Cucumis sativus
MEEAPSCSSILDAEIVGIRFSLANGQEICIAAISDCPITHASQLSNPFLGLPIEFGKCESCGTSEPGKCEGHFGYIELPIPIYHPNHITELKKMLSLLCLKCLKMKKTKNIGFAERLLSSCCEDASQVTIREAKKADGASYLQLKVPSRTSLQERFWDFLERYGFRYGDNFTRTLLPCEVKEMLKKIPNETRKKLAGRGYYPQDGYILQYLPVPPNCLSVPEISDGVTVMSSDPAVSMLKKILKQVEIIKGSRSGAPNFESHEVEANDLQLAVDQYLQVRGTVKASRGIDARFGVNKELNDPSTKAWLEKMRTLFIRKGSGFSSRSVITGDAYKLVNEIGVPFEVAQRITFEERVSVHNIRYLQELVDKKLCLTYRDGSSAYSLREGSMGHTYLKPGQIVHRRIMDGDIVFINRPPTTHKHSLQALRVYLHDDHVVKINPLICGPLSADFDGDCIHLFYPQSIAAKAEVLGLFSVEKQLLSSHSGNLNLQLANDSLLSLKMMFRKYFLGKAAAQQLAMFVSSYLPPPALLGVRSGSLHWTALQILQTVLPASFDCHGDSYLIKNSNFLKFDFDRDAMPSLINEILTSIFFQKGPEEVLKFFDSLQPLLMEHIFSEGFSVGLDDYSMPMAFLQALQKNIQVLSPLLYQLRSTFNELVELQLENHLRSVKVPFTNFILKLSSLGKLFDSKSESAINKVVQQIGFLGLQLSDKGRFYSKSLIEDVASLFHNRYSSDKIDYPSAEFGLVKGCFFHGLDPYEEMVHSISTREVMVRSSRGLTEPGTLFKNLMAILRDVVICYDGTVRNVCSNSIIQLEYGMKAGMMQPYSLFPPGEPVGVLAATAMSTPAYKAVLDSTPSSNSSWDMMKEILLCKVSFKNEPIDRRVILYLNNCACGRKYCNENAAYVVKSHLKKVTLKDAAMDFMIEYNRQPTPSGLGPGLVGHVHLNRMLLKELNIDMTEVLRRCQETMSSFKKKKKKIAHALRFSISEHCAFHQWNGEESIDMPCLIFWHQTRDVHLERTAHILADIVFPLLSETIIKGDPRIKSASVIWISPDSTSWQKNPSRWQDGELALDVCLEKSAVKQNGDAWRNVLDCCLPVLHLIDTRRSVPYAIKQVQELLGISCAFDQMIQRLSKSVSMVSKGVLGDHLILLANSMTCTGNMIGFNSGGYKALSRALNIQVPFTEATLFTPRKCFEKAAEKCHKDSLSSIVASCSWGKHVAVGTGSRFDILWDQKELGCKQDDVVDVYNFLHMVRSGKSEEPTSACLGEEIEDIMVEDEYGELTLSPEPFSTSEKPVFEDSAEFEHCLDNYPGESKWEKAPSLGAVSTGGGQWESNENGKATNSSDGNDWSGWGRKAEPDVTVTNAQENTSNSAWDTTSSWGNKATNSSNDNDWSNCSTKEVERDSFTSMEKTPKSGGWDSASTWGTKTKDDSFKRETAPKKSSQWSGLQKDKAETQDAFHKKAEMASKSGGWEDKAWSRGTSKTEDNWSSQVKDKAESFQVQVQEVSSKTNGWGSTGGWTKNSGGDHQSEAGWNDGQASMDREKVSDRWDRKATQKLESHQTSSWGSPTVGDSKDSFPSKAVDHSDSVVNHSWDRQKSPEASQGFGNDAWGQQKSRDVIKPSLANNESNLSGWGSQIESNEGSDHGFDQVTNEQKSSDTRGWDSQEKTDKPWDKQKSLEASQSWGSQNDSLGSWGQPQRASEECSRESQDDSSTQFSQLKPPETSLGWEQQKSPEVSHGWGSHKESSEQTSSHGWDKKNQGSKGWGGNAGEWKNRKNRPPKSPGMSNDDANLRALYTASGQRLDMFTSEEQDILADIEPIMQSIRKVMHQSGYNDGDPLSAEDQSFVLQSVFNFHPDKAAKMGAGIDHFMVSRHSSFQESRCFYVVTTDGHKEDFSYRKCLDNFIKGKYPDLAEMFVAKYFRKPRPNRNRDRNPASEENENKSIGGELTPIPEEAQNGSQQ

SEQ ID NO: 57 - protein, 1890 aa, Vitis vinifera
MEEDSSTILDGEISGIRFGLATRQEICIASVSDCPISHASQLTNPFLGLPLEFGKCESCGTAEPGQCEGHFGYIELPIPIYHPGHVSELKRMLSLLCLKCLKIRKSKVSLLINYFLDRMDLHCCALTTSNLDLAALILFSPQDIRCYHMFSFAIYITHPFSRIQTDKVTNNGITEQLLAPCCQDSPQVSVREFRPTEGACFLELKIPSRSRPKDGFWDFLARYGYRYGHNLSRILLPSEVMEILRRIPEDTRKKLVRKGYFPQDGYILQYLPVPPNCLSVPDISDGVSIMSSDLSVSMLKKVLKQIEVIKGSRSGEPNFESHKIEANNLQSSIEQYLEVRGTAKTSRSLDTRFGSSKEPNESSTKAWLEKMRTLFIRKGSGFSSRSVITGDAYKRVNEIGLPFEIAQRITFEERVNVHNMKHLQNLVDEKLCLTYRDGLSTYSLREGSKGHTFLRPGQVVHRRIMDGDIVFINRPPTTHKHSLQALSVYVHDDHTVKINPLICGPLSADFDGDCVHLFYPQSLGAKAEVLELFSVEKQLLSSHSGNLNLQLATDSLLSLKVLFERYFLNKAAAQQLVMFVSMSLPRPALLKSPCSGPCWTALQILQTALPSYFDCIGERHWISKSAILKVDYNRDVLQSLVNEIVTSIFSEKGPNEVLKFFDSLQPLLMENLFSEGFSVSLEDFSIPSEVTQNIQKNVEDISSLLYNLRSMYNELLQLQAENHLRLTKVPVANFILNSSALGNLIDSKSDSAINKVVQQIGFLGQQLSEKGKFYSRTLVEGMAYLFKSKYPFHGADYPSGEFGLIRSCFFHGLDPYEEMVHSISTREIIVRSSRGLSEPGTLFKNLMAILRDVVICYDGTVRNVCSNSIIQFEYGVKARTKPQHFFPAGEPVGVLAATAMSNPAYKAVLDSSPSSNSSWELMKEILLCQVNFKNDLIDRRVILYLNDCDCGRKYCRENAAYLVKNQLKKASLKDTAVEFMIEYVKQHAVSGSSEPGTGLVGHIHLNKLLLQDLNVSMQEVCQKCEETINSFRKKKNVGPFFKKIILSFRECCTFQHSCQSKGSDMPCLLFFWQGNRDDNLEQILHILAHKICPVLLQTIIKGDSRVCTVNIIWISPDTTTWIRNPCKSRKGELALDIVLEKAAVKQRGDAWRIVLDACLPVLHLIDTRRSIPYAIKQVQELLGISCAFDQAVQRLSKSVTMVAKGVLKEHLILLANSMTCAGNLIGFNSGGYKALSRALNLQVPFTEATLFTPRKCFEKASEKCHTDSLSSIVASCSWGKHVTVGTGSRFDVLWDTKEIGPAQDGGIDIYSFLHLVRSGSYGKEPDTACLGAEVEDLILEDENLELGMSPEHSSNFEKPVFEDSAEFQNTWENHVPGSGGDWAVNQNKETTASTLKPSAWSSWGTDKVTMKDTFSTREPDESSRSAGWDDKGTWGTDKAQNTAFRRTHEDSPRSSGRDETFRDGRPQFASSAWGKKIDEADKTGWNKNDGKPQMDKLRESYDWDCKVAQEKTTQSTYGGISSTTGDWKKNELQMEVVQHDESPVNEHSWDANLPEDPLAQATTSVGWDSSTGKDWTKRKLQSPSEQQRDPAIKSWSSSHNVMKEQSNQPASTHGWDSPGAKGWNDVEEQSQWNQRGSAVKNDQSESSHGWGPSNEQNQLPSSQGWGSPNAGAGHESETQSQWGQPSGKKSRPEGSRGWGSNNTEWKNKKNRPNKPQGPLNDDYSAGGIFTATRQRVDIFTSEEQDILLDVEPIMQSIRRIMHQAGYNDGDPLSADDQSYILDKVFNNHPDKAVKMGTGIDYVMVSRHSSFLESRCFYVVSTDGHKEDFSYRKCLENFIKEKYPDNAETFIGKYFRRPRAGGNRERSVIPEDGGNREQSVVPEETGSENRQ

SEQ ID NO: 58 - protein, 2010 aa, M. truncatula
MVYDGTLWCNLIHVYRFTKVFIMEDNATTSLLDGKVVGIRFSMATRHEISTASISDSQISHASQLANPFLGLPLEFGRCESCGTSEAGKCEGHFGYIELPVPIYHPSHVTELKKILSLVCLSCLRLKKTKVPSSSSGLAQRLLSPCCEDVNAAQVSIREVKTADGACYLALKVSKSKMHDGFWTFLEKYGYRYGGDHTRALLPCEAMEIIKRLPQETKKKLAGKGYFPQDGYILKYLPVPPNCLSVPVVSDGVSIMSSDPALTILRKLLRKVEVIRSSRSGEPNFESHQVEANDLQSVVDQYLQIRGTSKAARDIETHYGVNKELNDSSTKAWLEKMRTLFIRKGSGFSSRNVITGDGYKKINEVGIPLEVAQRITFEERVSIHNIHYLQKLVDENLCLTYKEGMSTYSLREGSKGHTYLKPGQIVHRRIMDGDTVFINRPPTTHKHSLQALVVYIHDDHTVKINPLICGPLGADFDGDCVHLFYPQSLAAKAEVLELFSVEKQLLSSHSGNLNLQLSADSLLSLKMLVKSCFLDRVAANQMAMFLLLPLPMPALLKATTGDSYWTSIQILQCALPFSFDCTGGRYLIRQREILEFDFTRDILPSIINEIAASIFFSKGPQEALNFFDVIQPFLMENIFAHGFSVGLQDFSISRAVKRVINRSIGKVSPLLRQLRGMYKELVAQQLEKVIQDIELPVINFALKSTKLGDLIDSKSKSAVDKVIQQIGFLGQQLFERGKFYSKGLVEDVASHFQLKCFYDKDDYPSAEFGLLKGCFFHGLDPYEELVHSIATREIIDRSSRGLSEPGTLFKNLMAILRDVVICYDGTVRNVCSNSIIQFEYGIQSGDAAQHLFPAGEPVGVLAATSMSNPAYKAVLDASPSSNSSWGFMKEILLCKVNFRNEPNDRRVILYLNDCDCGRNYCRENAAYLVQNQLRKVSLKDAALDFIVEYQQQRRRRDGTEDAGLVCHIRLKEVKLEELKINMTEVYQKCQEKLNSFSRKKKLSPFFKRTELIFSEFCSAPCVTFLWPDGVDLDQTTKVLADMICPVLLETIIQGDPRISSASIIWVNPGTNTWVRNPSKSSNGELALDVILEKEAVKQSGDAWRIVLDSCLPVLHLIDTRRSIPYAIKQIQELLGIACTFDQAIQRLAASVRMVAKGVLREHLILLASSMTCGGNLVGFNTGGYKTLARQLDIQVPFTDATLFTPRKCFERAAEKHHSDSLSSIVASCSWGKHVAVGTGSKFDIVWDPKEIKTNEIEGMNVYKFLNMVKGLANGEEETNACLGEDIDDLFDDENGDFDMSPQHASGFDAVFDETFELPNGSTSNGWDSNKDQIDQPNTNSNDWSGWGPNKSDLQVDVIQEDSSKSSAWGAATNQKSDQSASAWGKAVVQEDSSKSGAWGTATNQNSQQPSWGAATNQKSDQSASAWGKAVVQEDSSKSGAWGNAKSVVQEDSSKSGAPANTNHSSDQSCWGQITGGEERAQGESGGTKKWKADVSQEDSTNSGGWKAWGSSKPEVHEGESTKVQDSWNSQKWKAGEDVTQKDSQKSSAWGATKLKSNDIQEDSTNSGGWKAWGSSKPEVHEGESTKVQDSWNSQKWKAAEDVSQKDSQKSSAWGATKPKSNDNRSSWGQKKDEIHVMPEDSSRSNAWEQKPENVKDSWVAKVPVANSSWGKAKSPENRPWDSKNEPNNSFGKPNSQENEPWDSKNESDSSWGKPKSQESQPWDSKNESNSSWGKPKSQENHPWDSKNESNQTAGSRGWDSQVASANSESDKSFQWGKQGRDSFKKNRFEGSQSGGPNAGDWKNRSRPVRPPGQRFELYTPEEQDIMKDIEPIVQSIRRIMQLQGYNDGDPLANEDQKYVLENVFEHHPDKETKMGVGVDHVMVSKHSNFQDSRCLYVVLKDGKKEDFSYRKCLENLVRKKYPETAESFCGKYFRKPQPRVKRDQTPNPAGEQTAAPNPAGEQTAAPNPAGEQTATQNPPGEQTSTPNPAEEQTPTPAGDQTSTPVPMETN

SEQ ID NO: 59 - protein, 991 aa, Ricinus communis
MEDKENTQSSFLEGEVVGIKFGLATYKEISAASVSDCPISHSSQLTNPFLGLPLEFGKCESCGTSEPGKCEGHFGYIELPIPIYHPSHVSELKRMLSLLCLKCLKLKTNKIKSSGVAERLFSCCEEAAQISIKEVKTTDGAYILQLKLPSRMRLRDGFWNFLERYGFRYGDDITRTLLPCEVLEMLRRIPQDTRKKLAKKGYFPQDGYIMRYVPVPPNCLSVPDISDGVSVMSSDLSISMLKKVLKQVEIIKSSRSGEPNFESHEVEAVDLQSAVDQYLQVRGTAKSARDVGERFGVHKESNDSSTKAWLEKMRTLFIRKGSGFSSRSVITGDAYKCVNEIGIPSEIAQRITFEERVNAHNMQYLQELVDNKLCLTYRDGSSTYSLREGSKGHTFLRLGQIVHRRIMDGDMVFINRPPTTHKHSLQALSVYVHDGHTVKINPLICGPLSADFDGDCIHLFYPQSLAAKAEVLELFSVEKQLLSSHSGNLNLQLTSDSLLSLKTMFNTYFLDRAAAQQLAMFVSSSSLPQPALWKAHCSVPIWTALQILQTALPSQFDCSGERYLISNTDIVKVDFSRDVVQAVINDIVISMFFEKGPDAVFKFFNSLQPLLMESLFSEGFSVGLEDFYISRAAIGGTRRDFKVISSLLSQLRSTYNELMALQLENHIRRAKLPVADFIVRLSSIGDLIDYKSDSAMTKVVQQIGFLGLQISDRGKFYTKTLVEDMALHFESKYPSDIDYPSAKHGLIQSCFFHGLDPYEEMVHSISAREVMVRSTRGLSEPGTLFKNLMAILRDVVICYDGTVRNVCSNSIIQFEYGMKAGIKAQSLFPAGEPVGVLAATAMSNPAYKAVLDSTPSSNSSWELMKEILQCRVNFKNDITDRRVILYFNYCGCGKFYCQERLAYSVKNHLEKVILKDIALCFMCEYKSQPTIADAGLVGHVHLKKTKLQELNVSMEVIHRKCSETISSFGKKKKMGNLFKKIEFGMASNTFE

SEQ ID NO: 60 - protein, 2082 aa, Glycine max
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKVSKSKMQNGFWSFLEKYGYRYGGDHTRALLPCEAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEMMLEELKISMAYVFDKCHERLKSFSQKKKVNQSLKNIELSFSESCSSSHPAAPCLTFWLKNYDSDLDNAVKVLAEKICPVLFKTIIQGDPRISSASIIWVSPDTNTWVRNPYKSSNGELALDIILEKEAVKQSGDAWRVVLDACLPVLHLIDTRRSIPYAIKQIQELLGISCTFDQAIQRVAASVKMVAKGVLREHLILLASSMTCGGNLVGFNIGGYKALSRQLNIQVPFTDATLFTPKKCFERAAEKCHTDSLSSIVASCSWGKHVAVGTGSKFDVVWDANEIKSNEIEGMDVYSFLHMVKSFTNGEEETDACLGEDIDDLLEEEYMDLGMSPQHNSGFEAVFEENPEVLNGSTSNGWDVSSNQGESKTNEWSGWASSNKAEIKDGRSEIAPKNSWGKTVNQEDSSKSNPWSTSTIADQTKTKSNEWSAWGSNKSEIPVGWASSNKTEIKDGRSETAQENSWGKTVNQEDSSKSNAWNTSTTVDHANTKSNEWSAWGSNQSEIPAGGSKAVQEDSWGSSKWKADVAQEDNSRLGAWDANAADQTKSSEWSGWGKKKDVTQEDNSRLGAWDANAADQTKSRDWSGWGKKKDITQEDNSRLGAWDANAADQTKSSEWSGWGKKKDVTQEDNSRLGAWDANTADQTKSNEWSGWGKKKEVTQEDNSRLGAWDANTADQTKSNEWSGWGKKKEVTQEDNSRFGAWDANAEDQTKSNEWSGWGKKKDVTQEDNSRLGAWDANAADQTKSNEWSDWGKKKEVTQEDNVQDSWGSGKRKDKVTQEDNSGSGGWGANRTDLAKSKSSEWSSWGKNKSEIPAGGSENVQNDSWGSGKLEDDTQKENSGSAWVRNKAETIDGGSEKPQEDAWNSGNWKAESKVGNASWGKPKSSESQAWDSHNQSNQNSSSQGWESHIASANSESEKGFQWGKQGRDSFKKNRFEGSQGRGSNAGDWKNRNRPPRAPGQRLDIYSSGEQDVLKDIEPIMQSIRRIMQQQGYNDGDPLAAEDQLFVLENVFEHHPDKETKMGTGIDYVMVNKHSSFQESRCFYVVCKDGESKDFSYRKCLANYISKKYPDLAESFLGKYFRKPRARGDQTATPGRDEAATPGEQTATPGRDEAATPAEQISTPTPMETNE

SEQ ID NO: 61 - protein, 1932 aa, Zea mays
MEEDHSVILISEGAIKSIKLSLSTGEEICTYSINECPVTHPSQLGNPFLGLPLEAGKCESCGASENDKCEGHFGYIELPVPIYHPCHVTELRQLLSLICLKCLRIKKGKVKQSNGKGNAAPTLCSYCRDIPALSLKEIKTTDGAIRLELRAPHNKHMTERSWNFLDKYGFHHGGCSHHRTLLPEEALNILKKVPDDTRRKLAARGYIVQTGYVMKYLPVPPNCLYIPEFTDGQSIMSYDISIALLKKVLQKIEQIKRSRSGSPNFESHDAESCDLQLAIGQYIRLRGTTRGPQDNTKRFTVGSADSAALSTKQWLEKMRTLFISKGSGFSSRSVLTGDPYIGLGVVGLPSEVAKRMTFEEQVTDININRLQDVVDKGLCLTYRDGQATYAITVGSKGYTTLKVGQTISRRIVDGDVVFLNRPPSTHKHSLQAFYAYVHDDHTVKINPLMCGPFSADFDGDCVHIYYPQSLAAKAEALELFSVERQLISSHSGKVNLQLGNDSLVAMKAMSHTTMLHKELANQLAMFVPFSLLAPAVIKPVPSWTISQIVQGAFPANLTCQGDTHLVRDSTIIRLDLGKESVQDSFPDLVSSILREKGPKEALQFLNVLEPLLMEFLLLDGLSISLRDFNVPKALLEEAQKDIRNQSLILEQSRCSTSQFVEFRVENNLKNVKQQISDSVGKFSDLGLLIDPKKEASMSKVVQQVGFVGLQLYREGKLYSRRLVEDCFTNFVNKHLAIGDEYPPEAYGLVQSSYFHGLNPYEELIHAISTREAMIRSSRGLSEPGTLFKNLMAILRDVVICYDGTVRNICSNSIIQLKYGEDDETDSSSVVPPGEPVGVLAATAISNPAYKAVLDSSQSNNASWESMKEILQTRTSYKNDVKDRKVVLFLNDCSCAKKFCKERAALAVQSCLKRVTLGDCATDICIEHQKQINLDGTSEAAPTLVGHIHLDKGHLERINISTQDILQKCQEVSGRFGKKKGHLCHIFKKITFATCDCSFTQMPIDGKLHKVPCVQFAFSDDIVLSESIERAVNVIADSVCSVLLDTIIKGDPRIQAAKVIWVESDAASWVKHTRKVSKGESALEIIVEKDDAVSNGDAWRTAIDACLPVLNLIDTRRSIPYGIQQVRELIGISCAFDQVVQRLSTTVKMVNKGVLKDHLILVANSMTCTGNLIGFNIAGYKATFRSLKVQVPFTESTLFTPMKCFEKAAEKCDSDSLGCVVSSSAWGKHAAVGTGSSFQILWNENQLKSNKEYGDGLYDFLALVRTDQEKTDYMFLDDVDYLVEENAADDMCLSPEPDGTLGKPTFEDNFEEQNIQKGSSWEIGITTNSSWEQNASVANDSGDWGGWSSGGGAAAKPADQDNSWEVHAKVQDNSTTDWGGWSVEKPTGEATVSGEPAETDTWADKGAKMESDAGDGNWEKSSTPEASKKNDSSENTWDKRKGDGGDGAWGNRSDDGHGNWEHPSNWNGQSLDVDQDTWGNARGKKKADGNYCQWEEQPSNYKQKKTNADHDSSYNNVMPSSEIAWNAGDGTGRPNAKSNAESSWGEEDKMESDDHPKVPKESDTWNTGRSNESPWDNTDALQDSWVKSAARNNNTQDGSWDKVVSMKDLDSLQDSWSKATIQTNDAQNDSWDNVAKNAPDSAAEDSWGAATPAETTDSGNKEWKSDGWGAKSGNWSSQRNNPGRPPRRPDERGPPPPRQRFELTVAEKNILLEVEPIKLRVRSIFREACDGVRLNPEDEKFILEKVLEHHPEKQSKVSGEIDYLTVNKHQTFQDTRCFFVVSTDGSQADFSYLKCLENFVRKSYTEDADTFCMKYLRPRRRQAPPADVGTASGAPDEVPPSTAAETEQGTPPAPQAEVPQETWGSPAVPLEGGTHIAGPDSTGDAVILGEQHDLTPASPAVAPQVASEPDTTDGTGLLGKAPQADWGPRFDAD

SEQ ID NO: 62 - protein, 1571 aa, Sorghum bicolor
MEDDDPAAAGLTVPEAFIRRVKLSVTSNQEIVSTSPLFPSQDPIPITHCSQLQDNPSLGLPLQDGSTCESCGATQLDKCDGHFGFIKLPEPIYHPSHIAELGKILNLVCLRCLRLKKPKKVTGKESRFTSCSYCQELSPLCVSQVKKSNGARSLELKLPLKQEVADGFWSFLDQFGFHTSGTSHRRPLHPKEVQDIMKKITEKTRARLAARGYNLQDGFVMDNMSIPPNCLQISNMLDENTEMCPPTSKGLLHKVLRTIEQIESLNISHPNIEARELGADDLQVAVADYMNMGGAAKVSQHVTFTRQPAPKQWHKKMKTLFLSKSSSYTCRAVITGDPYIGLDVVGVPDEIARRMSVQECVTNYNIARLQDMMNKGLCLTYTDLNTNTYDLDGKKGNKKCIMLRVGETVDRRVLDGDLVFLNKPPSTDMHSIQALYVHVHDDHTIKINPLICGPLEADFDGDCVHIFFPRSVLARVEAAELFAVEKQLLNSHNAKLNFQIKNDYLLALRIMCDRSYSKEKANQIAMFSSGMIPPCNPWTICDRWTIPQILQTTDALRIVPSHPNTVGASVTAIITSTLSEKGPREAIKLINLLQPLLMESLLMDGFSISLKDLDGQSAMQKANQSISLEIDKFSKSIVDFIANSSALGLLVDPKNDSALMNLVEQVGFLGYQLQSTDRLYSNNLVEDCYNFLEKRSGSTKCYDPPKGHDFVTSSFYNGLNPYEELLHSISVREKIERSSSKGLAEAGNLFKNMMAMLRDVTVCYDGTMRTSYNNSIVQFDSTNVSSSLTPGDSIGILAATVFANAAYKAVLVPNQKNMTSWDSMKEVLLTNACSKTGTIDQKAILYLNKCFCGLKFCSELAAHRVQSCLKRIKLEYCAIEVSIKYQQEATQAAQCLVGHIHLDKEQLNWMEITMGNILQTCQKNVNKHVMKNRQLMQILKTTEIISSEYCLCGQDIGDERALQVSCLQCFIHASTTTVQPESNVIQMMTNTIFPILLDTVIKGDPQVQEAKLIWVEPKLTRWVKNSSAEQKGELAVEITVEKIAAAENGGTWGVVMDACVPVMDLIDTTRSAPCNIQEVQKVFGISSVFDRVVQFLMFCPPLGSFFQHLSKAVGMVTKSVLMEHLITVASSMTCTGSLHGFNRSGSKATFQSLKVQAPFTEATLSRPMQCFRKSAEKVDSDQLDSVVSTCSWGNHAAIGTGSAFKIHWNDENQSASNEILREYNLYDFLEAVGRIGATEQKTDAPHSLCLYDVGQLPEDEVQEDEVVCFGGTSPISWTDKPKGDSLLHDFMGRAGMWSTVQKHQEMQNKTKWNSASTRGQNKRQFTGQVYARKQPKHSWSQAATHQNNKLSWCGENVAGAQDFANAESSKGGWNRKNSGFGRGGHRGGGRGMAFANAESSSSGGWNRKNSGFGRGGRRGGGRGMWKSEGSHRGGSNSTNWRAQNNNSARQCGISYSFTPVEQQIYTQVEPIIKNVKRIIRESRDGMKLSQDDEMFIMNKILMYHPEKEKKMAGQGNYIMVNKHQTFPSSRCLYVASSDGSSSDFSYKKCLENFIRIHYPHAAESFCRKYFK

SEQ ID NO: 63 - protein, 2017 aa, Oryza sativa
MEEDQSAIPVAEGAIKSIKLSLSTEDEIRTYSINDCPVTHPSQLGNPFLGLPLETGKCESCGASENGKCEGHFGYIELPVPIYHPCHVTELRQILNVVCLKCLRVKKGKVKQTEGKDNTSALSCYYCRDLPALSLKEIKTADGAFRLELKMPPRKFMTEGSWNFLDKYGFHHGGTSHCRTLLPEEALNILKKIPEETKRKLAARGYIAQSGYVMKYLPVPPNCLYIPEFTDGQSIMSYDISISLLKKVLQKIEQIKKSRAGSPNFESHEVESCDLQLSIAQYIHLRGTTRGPQDNTKRFAISTDPSALSTKQWLEKMRTLFISKGSGFSSRSVLTGDPYIGVDVIGLPSEVAKRITFEEQVTDINLNRLQEIVDKGLCLTYRDGQATYAITVGSKGHTTLKVGQTISRRIVDGDVVFLNRPPSTHKHSLQAFRVYVHEDHTVKINPLICAPFAADFDGDCVHIYYPQSLAAKAEALELFSVEKQLTSSHSGKVNLQLVSDSLLALKHMSSRTMLSKEAANQLAMLVTCSLPDPAVIKSKPYWTISQIVQGALPKALTSQGDKHVVRDSTIIKLDLDKESVQTSFSDLVYSTLSVKGPGEALQFLNVLQPLLMELILLDGFSVSLQDFNVPKVLLEEAQKNIEKQSLILEQSRFAENQVVEMRVDNNLKDIKQQISDFVVKRSHLGLLIDPKSDSSVSKVVQQLGFVGLQLYREGKFYSRRLVEDCYYTFVNKHPAVREEHSPEAYGLVRSSYFHGLNPYEELVHAISTREAIVRSSRGLTEPGTLFKNLMALLRDVVICYDGTVRNVCSKSIIQLNYTEDDALDFPSAIGPGEPVGVLAATAISNPAYKAVLDASQSNNTSWERMKEILQTTSRYKNDMKDRKVILFLNDCSCAKKFCKEKAAIAVQGCLRRITLEDCATDICIEDGNWAAPAGFQHPVPPPQCKILPVPIPIPAHGSVKFPPVPIPAPEHLKYNIHVVRYQKQIGLDGTSEAAPALVGHIHLDRAHLERINISTEDILQKCQEVSGKYGKKKGHLSNLFKNITFSTCDCLFTQKLVDGKLPKLPCLQFFVSDNMIVSESVERAVSVLADSLCGVLLNTIIKGDPRIQEAKIVWVGSDATSWVKNTQKASKGEPAVEIIVEEEEALHIGDAWRTTMDACIPVLNLIDIRRSIPYGIQQVRELLGISCAFDQVVQRLSTTVRMVAKDVLKDHLVLVANSMTFTGNLNGFNNAGYKATFRSLKVQVPFTESTLITPMKCFEKAAEKCHSDSLGCVVSSCSWGKHAASGTGSSFQILWNESQLKSNKEYGDGLYDYLALVRTDEEKARYTFFDDVDYLAEENEADVCLSPELDGTIGQPIFDDNLEEQDVQNNSSWDNGTTTNASWEQNGSAGNDSDKWGGWNDAAAGADTGVTKPANQGNSCWDVPATVEKSSSDWGGWGTEKAKEKEKISEEPAQHDAWSVQGPKRATDGGASWKKQSSTQNDGNSWKENKGRGSNGGSWEKDNAQKGSWGRGNDEAENNNDVQNKSWETVAADAHASTEKSWGNVTASPSDNAWSAAPVSQGNGSSDTKQSDSWDGWKSAGVDKAINKDKESLGNVPASPSFSAWNASPVSQGNERSDAKQSDSWDGWKSAGVDKAINKDKESLGNVPASPSFSAWNAAPVSQGNERLDAKQSDSWDGWKSAGVDDSVKDKESWGNVPASPSDSAWNAAPVSQGNESSDAKQSDSWDGWKSAGVDASTNKDKESWGNVPASPSDSAWNAAPVSQGDDVWNSAEANESRNKDWKSDGWGARGGNWRGQRNNPGRPPRKPDGRGLPRRPDERGPPRRHFDLTAEEEKILGEIEPTVLSIRKIFRESIDSIKLSPEDEKFIKENVLEHHPEKQSKVSGEIDHIMVDKHQVFQDSRCLFVVSSDGTRSDFSYLKCMENFVRKTYPEHGDSFCKKYFKRRRDQPPAADGGTAPGTPAGATQSTAVDTQEGTSQQTQPDIATAPAATQQETLQDTPAPPADDGLLGKGPSPSD

SEQ ID NO: 64 - protein, 1954 aa, Brachypodium distachyon
MEEDQSAVLVAEGAIKSIKLSLSTEDEILTYSINDCPVTHPSQLGNPFLGLPLETGKCESCGASENGKCEGHFGYIELPVPIYHPCHVSELRQLLSLVCLKCLRIKKGKAKQSNGKENVSVTACSYCRDVPALSLKEVKTADGAFRLELRAPPRRLMKDSSWNFLDKYGFHHGGASHFRTLLPEEALNILKKIPDDTRKKLAARGYIAQSGYVMKYLPVPPNCLYIPEFTDGQSIMSYDISISLLKKILHRIEQIKKSRAGTPNFESHEAESSDLQISIAQYIHLRGTTKGPQDTKRFTISTDSSHLSTKQWLEKMRTLFISKGSGFSSRSVLTGDPYIGVDVVGLPSEVAKRITFEEQVTDINIKRLQEVVDKGLCLTYRDGQTTYAITVGSKGYTTLKVGQTISRRIVDGDVVFLNRPPSTHKHSLQAFYVYIHDDHTVKINPLICSPLAADFDGDCVHIYYPQSLAAKAEALELFSVEKQLTNSHNGKVNLQLSNDSLLALKHMSSRTVLSKESANQLAMLLSFSLPDPAVVKLKPCWTITQIIQGALPAALTCEGGRFLVKDSTVIKLDLAKESVQASFSDLVSSILCVKGPGGALQFLNALQPLLMEYLLLDGFSVSLQDFNVPKVLLEEVHKSIQEQSLVLEQSRCSKSQFVEMRVDNNLKDVKQQISDFVVESSHLGLLIDPKSEPSMSKVVQQLGFVGLQLYREGKFYSSRLVEDCFSSFVDKHPPIVGNQHPPEAYGLVQNSYFHGLNPYEELVHSISTREAIVRSSRGLTEPGTLFKNLMAILRDVVICYDGTVRNICSNSIMQLKYNEDDATDIPSALTPGEPVGVLAATAISNPAYKAVLDASQSNNTSWASMKEILQTKVSYKNDTNDRKVILFLNDCSCPKKFCKEKAAIAVQNRLKRVTLEDCATDICIEYHKQILDGSSEATPALVGHIHLEKARLDMINVSTEDILQKCQEVSLKHGKKKGHLGHLFKKITFSTCDCSFTQKPMIDGKLPKVPCLQFSFSEDIPMLSESVERAVSVLANSLCDVLLDTIIKGDPRIQEAKIMWVGSDAQSWVKNTRKVSKGEPTVEIVVEKNEASKQGDAWRIAMDACIPVIDLIDTRRSIPYGIQQVRELLGISCSFDQIVQRLSTTMKTVAKGILKDHLILVANSMTCTGNLYGFNTGGYRATFRALKVQVPFTESTLFTPMKCFEKAAEKCHSDALGCVVSSCSWGKHAALGTGSSFQILWNENQLKSNKEYGDGLYDFLAMVRTDQEKARYTFLDDVDYLVEDNAMDDICLSPELNGTHGVPTFEDNFEHQDTQNGNSWENGTKANASWEQNASAGNDSDNWGGWSNAAAAADTGAAKPADQGNSSWDVPATAENDSTDWGGWGNEKAKDNRTVSTEPAELDTWSDRGAKKGTDGGGGSWGKQTNTCEDSGTNLERNSWAKRPSSPSLSTWAKKNSDGGDGTWDKQANSCKKNVEQDSWKNMPVSPARNAWNKKESSRGDATWEMRASTLEEKKTSESNEGSWEKSNAQKDSWGNTQHGSSDKMAVKDNDMQQDPWGHIATQNINAQDDLWGSVAAKAQTSTAENTDAQDDSWGAVAAKAQTSTAQESWGNVAASPSDNAWKAPPISQTSAAEHTDAHNDSWGIVAAKAQTSTAQQESWGNATASPSDNAWNAAPMDLDAKQPGSWDGWSSALAEDSNKADDSSNKNKGWKSDGWGAKGNRRDQRDNPSMPPMRPDERPPRPRFEVPAEAKKILREIEPIVSMVRKIFRESCDGVRLPLEDEKFIKESILEHHPEKERKVPGEIDHIMVNKHHIFQESRCFYVVLADGTHTDFSYNKCMDNYVRKTYTDAAEHADLVSQMYFKKRDRDRAAAVDGGSTPANASQSTQVMETSQDEAPQEAQPETCVATQEETRVSPQETPAATTQQEETENNPDSASEADYHSASEAGLPEGV

SEQ ID NO: 65 - protein, 1920 aa, Populus trichocarpa
MDENSQSSIFDGEITGIRFGLATQKEICTASISDCPISHSSQLTNPFLGLPLEFGKCESCGTSEPGKCEGHFGFIHLPIPIYHPSHISELKRMLSLICLKCLKLKRNKIQIKSNGVAERLLSCCEVSIKECAQISIREVKNTDGACFLELKLPSRSRLRDGCWNFLERYGFRYGDDFTRPLLPCEVMQILKRIPAETRKKLSGKGYFPQDGYILQQLPVPPNCLSVPVVSDGITVMSSDLSISMLKKVLKQAEVIRSSRSGAPNFDAHKDEATSLQSMVDQYLQVRGTTKTSRDVDTRYGVKKESSESTTKAWLEKMRTLFIRKGSGFSSRSVITGDAYTLVNQVGIPYEIAQRITFEERVSVHNMRYLQELVDNKLCLTYKDGSSTYSLREGSKGHTFLRPGQVVHRRIMDGDIVFINRPPTTHKHSLQALSVYVHDDHAVKINPLICGPLSADFDGDCVHLFYPQSLAAKAEVLELFSVEKQLLSSHSGNLNLQLTTDSLLSLKMMFKACFLGKSAAQQLAMFISPYLPQPALLKVNCFFPHWTAHQILQMALPACFNCSGERFLIINSNFLKVDFNRDVVASVINEILISMFFEKGSGAVLKFFNSLQPMLMENLFSEGFSVSLEDFSISRAVKQRIPESFKAISPLLCNLRSTFNELVELQVENHIRDVKQPVREFILTSSALGYLIDSKSDAAVTKVVQQIGFLGLQVSDRGKLYSKTLVEDLASHFLSKYPANLFDYPSAQYGLIQNSFFHGLDAYEEMAHSISTREVIVRSSRGLSEPGTLFKNLMAILRDVVICYDGTVRNVSSNSIIQFEYGVKVGTESQSLFPAGEPVGVLAATAMSNPAYKAVLDSTPSSNCSWDMMKEILLCKVGFKNDLADRRVILYLNDCGCGRNYCQERAAYLVKNHLEKVSLKDIAKCFMIEYKSQQIPESFGSDAGLVGHVHLDKRKLQDLNITAQVILEKCQETVNTFRKKKKVGNLFKKTILLVSESCSFQQCIDESPCLMFFWQGADDVHLERTSNILADMICPVLLETIIKGDHRISCANIIWATPETNTWIRNPSRTQKGELALDIVLEKSVVKKSGDAWRIVLDSCLPVLHLINTTRSIPYAIKQVQELLGVSCAFDTAVQRLSKSVTMVAKGVLKEHLILLGNSMTCAGSLIGFYTGGYKTLSRSLDIQVPFTEATLFTPRKCFEKAAEKCHTDSLSSIVASCAWGKHVTVGTGSHFDVLWDTKEACLNPEGSMDVYSFLNMVRSTAGGEESVTACLGAEVDDLMLEDEDWNLSPEHNSSSDKPTFEDSAEFQDFLGNQPAESNWEKISSLKDRSRSSGNWDVDKNDGAVKEKPWSLGMNTAEANDVASSGWDTAAARTTNNSWNSENNVAQSNSFSGWATKKPEPHNGFATKVQEEPTTSNDWDAGAAWGRKDRDNKFAETNASKSWWGKVTDGDESGQNKSKNKRPEDQDVGTHGWDDKMSQDQSISGWASKTTQEATTESLGWDSKGNSNPGDAACGWKAASTWGAENTDGDKLWGKEVSSNQADTASGWGKPKSPEISLGWGSTKESVKSDRGWGVSSSGGGRDKKTENQSLAGQGKESGGWGNKVTSNQADTASGWGKPKSSENSQGWGLSKESGKEVHEWGVPNSAGGNGSETNNNNENQSLVEQGKESGWDNKASSNQEGTASGWGKPKSPALSEGWGSPREPVKAVHGWGVPNSGGGNGSGRDQQWGQQSREFKKDRFEGSRGWGSNNGDWKNKRNRPSKPHEDLNASGIFTTTRQRLDVFTSQEQDILSDIEPLMLSIRRIMHQTGYNDGDPLSADDQSYVLDNVFHYHPDKAVKMGAGIDHVTVSRHSNFQESRCFYIVSTDGCKQDFSYRKCLENFIKGKYPDLADEFIAKYFARRGNRQRTPAPEGTEEEKQAL

SEQ ID NO: 66 - protein, 1869 aa, B. Napus
MEEASSSDILEAEIVGISFALATHRQIRLASISDAGINHASQLSNAFLGLPLEFGKCEACGATEPDKCEGHFGYIHLPVPIYHPAHVSELKQMLSLLCLKCLKIKKIKSTSSGLAERLLGVCCEEASNITIKDKSSDGASYLQLKLPSRTRLQEGFWNFLERYGYRYGSDHTRPLLAREVKEILRRIPEETRKKLTAKGHIPQEGYILEYLPVPPNCLSVPEVSDGSNSMSVDPSRIELKDVLRKVVAINNSRSGETNFESHRAEANEMFRVVDTYLQVRGTAKPTRNIDMRFGVSKISDSSSSKAWTEKMRTLFIRKGSGFSSRSVITGDAFRNVNEVGIPMEIAHRITFEERVSVHNIGYLQELVDNKMCLSYTQGSTTYSLRDGSKGHTVLKPGQIVHRRVMDGDVVFINRPPTTHKHSLQALRVYVHEDNTVKINPLMCGPLSADFDGDCVHLFYPQSLTAKAEVLELFSVDKQLRSSHTGQLILQLGLDSLLSLRVMMEQVFLDKASAQQLAMYGSRSLPSPAVVKSSKSSPAWTFFQILQLAFPERLSCRGDGFIVGGSDLLSFDFGVDALASIINGIVTGIMVEKGPKEALAFFDSLQPLLMEHLDPQGFSLSLEDLSMSREDMGVIHNLIVREISPMVSRLRLSYEDELQLENSIQKVKEVAANFMLKSYSMRNLIDIKSNSAINKLVQQIGFLGLQLSDKKKLYTKTLVEDMAQFYKKKYVSTSSSGDFGIVKGCFFHGLDPYEEMAHSVAAREVIVRSSRGLAEPGTLFKNLMAVLRDIVITNDGTVRNTCSNSIVQFKYELSSDNENQGLFEAGDPVGVLAATAMSNPAYKAVLDFSPNSNSSWELMKEVLLCKVNFQNTTNDRRVILYLNECRCGKKYCQENSAYTVRNKLKKVSLKDTAVEFLVEYRKQQAISEIFGMDICLHGHIHLNKTLLEGWNISMQDILQRCEDAINSLVQKKKKKAEDFKKMNLSVSECCSFRGPGSSKDSDMPCLMFSSYNATDPDLERTLDVLCNTIYPVLLETVIKGDPRIASANIIWNSPETTTWIRSLHASRRGEWVLDVTVEKSDVKQSGDAWRVVIDSCLSVLHLIDTKRSIPYSIKQVQELLGLSCAFEQAVQRLSASVRKVSKGVLKEHIILVANNMTCSGDMLGFNSGGYKALTRSLNIKAPFTEATLIAPRKCFEKAAEKCHKDSLSTVVGSCSWGKRVDVGTGSQFELLWNKKETGLENDDETDVFSFLQMVRSTKTADAYVSSPGFDVTEEEMAEWAESPERDSALGEPKFDDSAEFQNLLDEGKASESKWDNGSLWENGCSSGSEWGVSKNAGGEENTQSGWGKAANVENEDASSGWNSKKDAQEATNTDSWGAWGSKTKDDAENATPNWGTKPAQNDSVVIENGEPSSDVWGPKAVSDKPWGKKNSETEPAPAAWGKTNSESGATWGSRDKSKFETESGGAAWGSQAKNNSETEPGSGAAAWGTWDKKKSETESGGGGAAWGSQAKNNSETESGSGAAAWGKKKPETESGGGAAWGSQAKKNSESQLGAANWGSKDTNNSENGSDSAAWGKKKNSEAEPTSVAWGSWGQPSPPASDKDAQEDDGNPWVSLKATSSGDKEGNETSQWGVPNKRYPSAGSQSQGGGGGADWKRNRPPRTPGSESILGPMFTATRQRVDMFTSEEQELLSDVDPVMRRLRKIMHQSGYTDGEPISDEDKTYVLEQILNYHPDKDAKLGPGLDFITVDKHTTFTESRCFFVVSTDGTKQDFSYRKCINNYLVEKHPNLAEEFIAKYFRKRDNENRDKNSQEATPPGEQEPQTQPIDNGSQDSQPQPIGNEGGVTQPQSQIEDIQPIGNGGEDSQTEPQA

SEQ ID NO: 67-79 - skipped (13 entries)

SEQ ID NO: 80 - protein, 954 aa, A. thaliana
MDQLASLAESVAMEEDSEKQSIKGESSLEPDSTPSSPKITARWNPSEACRPLVDDAPIFYPTNEDFDDPLGYIEKLRSKAESYGICRIVPPVAWRPPCPLKEKKIWENSKFPTRIQFIDLLQNREPIKKSTKTKKRKRRRISKIGYTRRKRDSGCDTASSGSSDSEGKFGFQTGPDFTLEEFQKYDEYFKECYFQSEDHPGSKASENKKFKPKVKDLEGEYWRIVEQATDEVEVYYGADLETKKFGSGFPKYKPGYPISEADQYSQCGWNLNNLSRLPGSVLAFESCDISGVIVPWLYVGMCFSTFCWHVEDHHLYSMNYLHTGDPKVWYGIPGNHAESFENVMKKRLPDLFEEQPDLLHQLVTQLSPRILKEEGVPVYRAVQRSGEFILTFPKAYHSGFNCGFNCAEAVNVAPVDWLVHGQNAVEGYSKQRRKSSLSHDKLLLGAAMEATYCLWELSLSKKKTPVIARWKRVCSEDGLLTKAVKKRVQMEEERLNHLQDGFSLRKMEGDFDNKRERECFLCFYDLHMSASSCKCSPNRFACLIHAKDLCSCESKDRYILIRHTLDELWALVRALEGDLDAIDLWASKCRDQYPSQHPRAREYAYLKSAPCIKSRGSSKVQQREQNNLQLVSERLQSDLTSNKEVQLKQDGDSDVNRHGHESERNHVHGITDKSAVTDVKLGVGGKFDEKKISVESQNPHSVSDVGCSELAKKVDGCLGGKDQNAATNRLSLSVELLSSGSLVVKKLWCSKQAIYPKGFKSRVKFLSVLDPTNLTNYISEVLDAGLLGPLFRVSVEDYPTENFSNVSAEKCWQMVTQRLKLEIIKKCDQPVSSLTSLQPLESINGLEMFGFLSPHVIKVVEALDPKHQLEEYWNQKAVKLFGAEPIKEGEKDDTEKGGASDPSLDRDTRLLRGLLKKATPEELVMMHGLLCGETRNTELKEELSTLVDKMEISP

SEQ ID NO: 81 - protein, 948 aa, A. lyrata
MDQLASLAESVAMEEDSEKQSIKRESSLEPDSSPSSPKITARWNPSEACRPSVDDAPIFYPTNEDFDDPLGYIDKLRSKAESYGICRIVPPVAWRPPCPLKEKKIWENSKFPTRIQLIDLLQNREPIKKSTKTKKRKRRRISKIGYTRRRRDSGCDTASSSDSEGKFGFQTGPDFTLEEFQKYDEYFKECYFQAEDHPGSRASENKKFKPKVKDIEGEYWRIVEQATDEVEVYYGADLETKKFGSGFPKYTPGYPKSEADQYSECGWNLNNLSRLPGSVLAFESCDISGVIVPWLYVGMCFSTFCWHVEDHHLYSLNYLHTGDPKVWYGIPGNHAASFEDVMKKRLPDLFEEQPDLLHQLVTQLSPRILKEEGVPVYRAVQRSGEFILTFPKAYHSGFNCGFNCAEAVNVAPVDWLVHGQNAVEGYSKQRRKTSLSHDKLLLGAAMEATYCLWELSLSKKKNPVIARWKRVCSEDGLLTKAVKKRVQMEEERLHLLQDGFSLRKMEGDFDIKRERECFLCFYDLHMSASSCKCSPNRFACLTHAKDLCSCESKERFILIRHTLDELWALVRALEGDLDAIDLWASKCRDQYPSQHPRAREYSYLKTTSCLKSRSSSKVQQREQNNLQLVSERLQSDLTTNKEVQLKQDGDQDVNHHGHESERNHVHGITDKSAVTDVKLGEGVKFDEKKISVESQNPHSVSDVGCSELAKKVEGKDQDASTNRLSLSVELLNSGSLVVKKLWCSKQAIYPKGFKSRVKFLSVLDPTKLTNYISEVLDAGLLGPLFRVSVEDNPTENFSNVSAEKCWQMVTQRLKLEIIKKCDQPVSSLTSLQPLESINGLEMFGFLSPHVIKVVEALDPKHQLEEYWNQKAVKLFGAEPPKEGEKDDTEKGGASDPSLDRDTRLLRGLLKKATPEELVMMHGLLCGETRNTELKEELSTLVDKMEKSP

SEQ ID NO: 82 - protein, 1069 aa, C. Sativus
MTLQPMDRNKLEADSETKGDQSSKSSHKSNQTVERSGSPQHQKISARWDPNEACRPLVDEAPVFYPTVEEFEDTLGYIAKIRPQAESYGICRIVPPSSWNPPCVLKEKSKWENATFSTRIQQVDLLQNREPMKKKSRGRKRKRRRQSKAGTSARSTNLGVEATVTSESDEKFGFNSGSDFTLKDFQAYADHFRESYFGITKAQEDINFDIESSKRWEPSVEDIEGEYWRIVEKSNDEVEVYYGADIESATFCSGFPKASSLVTEGNLDPYVKSGWNLNNFPRLQGSVLCFEESDISGVLVPWLYVGMCFSSFCWHVEDHHLYSLNYMHWGDPKVWYGVPGSHASSLEAAMKKHLPDLFAEQPDLLHELVTQLSPSVLKSEGVPVYRVVQNSREFVLTFPRAYHAGFNCGFNCAEAVNVAPVDWLVHGQNAVELYSAQRHRTSLSHDKLLFGSAREATQALWEILVLEKKTPNNLNWKSVCGIDGDLTKVIKTRVKMEEERMNCLPTNMKLQKMESEIDCKSERECYACFYDLYLSSTSCKCSPDRFSCLKHASNFCSCQVDDRSVLFRYSINELHTLVEALEGGLDAIKEWASRYCKMEKDNESVAKVELDSGLNDKPSWSPQITDKLKRSDVPCSSSSHASSEVVQSESHRGSLSLNNSNLSSDSQNDNVNSEMLINKGKKVEQEGCIDLNVDIISEGNANCGPHISDTKTIIDLEETYPLVFEQKYICKAAHESELMDLDTDHVTTLPAHDYSSSVKDGVRICGSNASKLFGVDLSQSQSQLHSAFPYNNCSKVETSEHLDKRIPSWSSSHLKTFPFVEPLNIGTIMFGKPWHCEKAIFPKGFRSRVKFLSVLDPTSIVTYTSEVLDAGLLGPLFKVTLEESPGENFTNVSATKCWDMVVQRINREIERHNLRSGGRLPGQLLKEVDGLEMFGFLSPHVIQAIEALDPTHQCMEYWNHRKQQAIPANSGDNTFCESSALGLNFCWGETSATTFDINREEDETVTPTIGMERHHQNEVQVRSVLKGLLNKANPEELSVLQTIFCTDSQTTELRAEFASLIKEKQDKCR

SEQ ID NO: 83 - protein, 951 aa, V. vinfera
MTFHPTTSITNFIPFSIWLIGSIYFFNIKSGLSQLCDLVLLRIVFGIFWKDWVCHQKGPFFQRVVIDKLGFDTDCFWSMEQSSLEPEFQIKEDHSSKHALKNDSNIEYSGSPQNQKISARWNPTEACRPLIEEAPVFYPTVEEFQDTLNYIASIRPKAEPYGICRIVPPPSWVPPCPLREESIWKHLKFPTRMQQVDLLQNREPMRKKNRGRKRKRRRYSRMGTTRRHSRSEVSEANIVSDSDEKFGFHSGSDFTLEEFQKHADSFKEFYFGIKDAKDNLNSDGVECNKRWEPSVEDIEGEYWRIVEKPTDEVEVYYGADLETEAFVSGFPKASSLISENDSDQYVASGWNLNNFPRLPGSVLCFEQNDISGVLVPWLYVGMCFSSFCWHVEDHHLYSLNYLHWGDSKVWYGVPGSHASALENAMRKHLPDLFEEQPYLLNELVTQLSPSVLKSENVPVYRAIQNSGEFILTFPRAYHSGFNCGFNCAEAVNVAPVDWLSHGQSAVELYSEQCRKTSISHDKLLLASAQKAVQALRDPSVLGKEDQVNLSWKSVCGKDGTLTKAVKTRVQMEEERLDRLPIGWRLQKMERDFDLKNERECFSCFYDLHLSAASCECSPDQFACLKHASLICSCEPNRKFVLLRYTMDDLKTLVESLEGGLDAIEVWASEDLGLVSADKDACLTKGYESKVGQGFCIDLNLDTMSDEHVSGLQQVSYSCDSKATGNMNFCVEPMHFGTVLFGKPWCSKQAIFPKGFTSRVKFFSVCDPTQMCYYISEVLDAGLLGPLFKVTSEGCPSETFANVSPEKCWEMVLQKLQQEIIRHSSLGKQLLPSLECLQGVNGLEMFGFLSPPIIQVIEALDPNHQCLEYWNQKSRAKLFGFDLTKQDPDNSSIGRGDHSVGEDIKTTLQGFFKKANREELIMMYKVFCSEYTSAEWGVAFTTLTEEIRKTCK

SEQ ID NO: 84 - protein, 1003 aa, M. Truncatula
MKQMELDAIEDSPLRHKPKKDNALESPESLRSKKISARWDPSEACRPIIDEAPVFHPTIEEFEDTLSYIAKIRPLAEPYGICRIVPPACWVPPCLLKEKDIWENAEFSTRIQQIDLLQNREPMKKKSRGRKRKRRRNSKSGTCRRASKSASEANNASEADEKYGFQAGSDFTFKDFQQYASHFKECYFGLKDANEDGKVNDSNHQNRREPSEEEIEGEYWRIVEQPTDEVEVYYGADLETGVFGSGFSKASSIPKGYPDQYAISGWNLNNFPRLPGSVLSFEGSDISGVLVPWLYVGMCFSSFCWHVEDHHLYSLNYLHFGDSKIWYGVPGSHASALENAMKKHLPDLFEEVPNLLNDLVTQLSPSILKDEGVPVYRTVQNSGEFVITFPRGYHSGFNCGFNCAEAVNVAPVDWLTHGLNAVELYSLQRRKTSLSHDKLLFGSSLEAIRALAELTLHGKESSKNLKWRSYCGKDGVLTMAFKARIKMEEERLNCLPTHFKSLKMGNDFDLHTERECFSCFYDLYLSAVGCECSPDKYSCLTHASSFCMCEMDQRFVLLRYNMNELNKLLEALEGDSLALKLWESKNFGMVSAEANEVCMNKPEVDGDNGHEETGCAGTRDRSNSHATSEPMQCESHLVTLSAPNESIDSDNDNMIVVDKDKVDIADSHNKGDSVEEKACCSKIKKEQDNMEIVVDLSPSSSVVKTEVSSCSRNVHNPCTSDSGKYEGQQQMDSDSRKKPKIVVEKVIDTTSASISLTQESFLMQILSTSVKPISLGSVVHGKLWCNKHAIYPKGFKSRVNFFSIIDPTRICSYVSEVINAGLLGPLFKVTMEECPSVTFTETSADKCWESVLKRLHDKITEQRSLGELELPSLELLKSINGFRMFGFPLPSIVQAIEAQDPGHQCAEYWNHKGFPTSPGSVIDNCKVLCCSSSPTKVFGINLTDQAKDNIGGSSSSLEEMKSILQKASPEELSSLRKFLISDAQCSEWRITLTSLIDEIQKAL

SEQ ID NO: 85 - protein, 935 aa, R. Communis
MAYHYLNNVHMLVEGITNYDVGHTFSEFHHVIARWNPIEACRPSIDEAPVFYPTVEEFEDTLGYISNIRAKAEPFGICRIVPPLSWRPPCRLKEKDIWENAKFSTRIQQVDLLQNREPMRKKFRSRKRKRRRHSKMGASRRRATSCSEANAASEADEKFGFQSGSDFTLEEFQKYADHFKACYFGVMDSMEDVKPGIEHQKLEPSVEEIEGEYWRIIEQPTDEVEVYYGADLETGTFGSGFPKASSMAIEGDSDQYFDSGWNLNNLPRLPGSVLCFEESDISGVLVPWLYVGMCLSSFCWYRIMKSFGLFYFYFVLYLAVVYHWWFHLLGQVTQLSPSVLKAEGVPVYRVVQHSGEFVLTFPRAYHSGFNCGFNCAEAVNVAPVDWLAHGQYAVELYSKQHRKTSISHDKLLLGSAQEAVQALWELLHLGKETPGNLRWRNVCGKDGLLTQAVKTRVQMEEERLQNLPTHLKLQKMEKDFDLGNERECFMCFYDLHLSAASCKCCPEQFACLKHAKDFCSCENDESYVLVHYTVDELNRLVEALEGSLDAIKVWISKEFRLVSEADNGAHECKVEQKCDLFQNNYCEQSESPSCSPRTEELLGTNISCSNSQVSSEVTQSNSHDHIFNNDAMILKNKPVVKKESCIDLNLDFMSVDHENESFDASNSSGNKVRSDVETNKSRVNLSYNFGSFVEPINFGSIMLGKLWCSKQVIFPKGFRSRVQFLSVLDPRKSCSYISEIVDAGLLGPLFKVSLEEYPSETFTNVSAEKCWEMVLQRLNEEIMRRNTLGERGLPPVLPLQSINGLQMFGFSTSPILQAIEALDSNHQSVDYWKNRLVNLSTTSEVKQSLIGLGCNPVDPEDKIGNNVMTKYPDNLNAQGHSDEEEEVQHIVRGLFKKANSEELKIMRKVLCSDTQSAERRAALTTLMEEIQKTSR

SEQ ID NO: 86 - protein, 1049 aa, G. max
MEQLKLAADSEAKEDKSLGHKPKNNNALESSDSLRNKKISARWDPVEASRPIIEEAPVFYPTIEEFDDTLSYIAKIRPLAEPHGICRIVPPACWAPPCPLKEKDLWENTEFPTRIQQIDLLQNREPMRKKSSGRKRKRRKHSKTGTCRRKPANAASEAKNASESEEKFGFQSGSDFTLKDFQLYADFFKECYFGLRDTNGDRIVSDNNHQKIWEPSEEEIEGEYWRIIEQPTDEVEVYYGADLETGALGSGFPKASSLTKSESDQYAQSGWNLNNFARLPGSVLSYEGSDISGVLVPWLYVGMCFSSFCWHVEDHHLYSLNYLHWGDPKVWYGVPGSHAAALEKVMRKHLPDLFEEQPNLLNDLVTQFSPSILKSEGVPVYRTVQHSGEFVITFPRAYHAGFNCGFNCAEAVNVAPIDWLMHGQSAVELYRLQCRKTSLSHDKLLFGSALESVRALAELALGKETPKNLKWGSVCGKDGDLTKAVRARIKMEEERLDCLPTHLKLLKMNSNFDLYKERECFSCFYDLHLSAVGCECSPDRYSCLKHANLFCSCEMEKRFVLLRYTISELNKLLEALEGDSHAIEVWANKNFGMVSANANEVCIDKPDLEKDMYRTKNCEEMESSTGCVRTKDRSNLNAPSSPNSHITTEIVQFESHPVTCAAYDSIDSRHDNNNDKNLITDSKDKVDQAGSLDLNLDVISGENENHLLHIADNHHNKGVSVEEKVCCSEAKKEEDIMELCGEGNLSNLFSVLKTDFSSCSRGVRNYCTFDGGKIEKDLQVDSDSGKQHSNLFEREVIVTTHTSTSLMDESCLVQMFGTSVKLVSLGSVVYGKLWCSKHTLYPKGFKTQVNFFSIVDPKRICSYISEVIDAGFLGPLFKVTMEECPSEAFTDTSADNCWESVLKRLHHEIMRQKSLGELELPPFELLKSINGHRMFGFKLPSIIQAIEAQDPSHLCVEYWNHKVAPSGSVVDNFPFGSSSSLGNINTKIFGIDLIKQEKDNILEEMKSILQGASPDELRTMHKLIISDAQCCEWRVALIALMDGIRNACQ

SEQ ID NO: 87 - protein, 1239 aa, Z. mays
MLSAMMGIEGIAATVTEDPEPSIPPGFGPFAASASWGIQNDVKPADDHSSSVLALQSIDDDVEILEYLSSSVDHQSDTGCCISGSNTCRKSLRNRPPIDYSRFDQIADEDSDAEVADKGVNAVKHRQQFPKGVLRGCPECANCQKVIARWNPSGARRPVLDEAPVYYPTEEEFQDTLKYIEIIRPTAEPYGICRIVPPASWKPPCLLKEKNIWECSKFSTRVQKVDKLQNRKSPKKSRRGGMMKKRRKISETEENNHHQIGMQQNQERFGFEPGPEFTLQMFQKYADDFSDQYFMKDKCRDSPPSVEDIEGEYWRIVERPTEEIEVIYGADLETGTFGSGFPKLCPEMKSDVEDKYAQSGWNLNNLPRLQGSVLSFEGGDISGVLVPWLYVGMCFSSFCWHVEDHHLYSLNYMHWGAPKMWYGVPGKDAVNLEAAMRKHLPELFEEQPDLLHNLVTQFSPSLLKSEGVPVYRCVQHEGEFVLTFPRAYHAGFNCGFNCAEAVNVAPIDWLPVGQNAVDLYREQARKITISHDKLLLGAAREAIRAQWDILFLKRNSSVNLRWKSICGPDSTICKSLKARIEMELVQRQNISSPCQSRKMDSEFDSTDRECALCYYDLHLSASGCPCSPEKYACLVHAKQLCSCDWDKRFFLFRYDVNELNILADALGGKLSAIHRWGVSDLGLSLSSCVKREKVQDSKTVRRLTDGPRRSYMSQASTVSLIPSSVSTEQKKNEDKTLDLGCPGMNLPKISPEANNLRPSTEQIKSENLSQLKEPCVKNELSCPTSNGTSQEHKGGIGGHKLAAASMMVLSGQSFPANAGESVRNAHVLAVFKEGRDCTSSLTLREYHNRPVSMIDNGANMKLDLENIDNSHMLMSSPDFNATVCHSYKDQTFLTLETNTSVMTEKDSSQARNASQQFVSTALRTQNVSQEPLCTAIAPKQLIDPQVQKKSYGVFGSGSAHLGHLTVGNQQLNERWHQRQSDSLSSVEVRARGHSAMIVQPALENHSRNGVAQKGPRIANVVHRFKCSVEPIEIGAVLSGKLWSSSQAIFPKGFKSRVKYFSVVDPVQMTYYISEILDAGQQGPLFMVTVENCPGEIFINISPTKCWNMVRERLNMEIRRQLNMGRANLPTLQPPGSVDGHEMFGLLTPAIVQAIEARDRDYICTEYWRSRPHATIENRDNQNMSPQDPPLVALRGLFQRANCDELRALRSLLMSNRILGDNSRQQACQILDEEIAKQWH

SEQ ID NO: 88 - protein, 1221 aa, S. Bicolor
MMGTECIVATLGGDPEPSIPPGFGPFVALALQGIRDNVKSGDAHSSSAQAVQCKEKDVDIVEHGSANSRSGTPASTSGTHSCRRSLRNRPPIDYSQFDLIWDDESDVESAEKGVGSVRHRRQLPKGVLRGCAECADCQKVIARWNPSGARRPVLEEAPVFYPSEEEFKDTLKYIESICPRAEPYGICRIVPPPSWKPPCLLKEKNIWECSKFSTRVQKVDKLQNRKSSKKSRRGGMMKKRRKLLELEDNNNLNHSQTGMQQNQERFGFEPGPEFTLQTFKKYADDFNEQYFKKEVSGDSVPSVEDIEGEYWRIVEKPTEEIEVVYGADLETGTFGSGFPKFSPEVKSDVEHKYAESGWNLNNLPRLQGSVLSFEGGDISGVLVPWVYVGMCFSSFCWHVEDHHLYSLNYMHWGAPKMWYGVPGKDAVNLEAAMRKHLPDLFEEQPDLLHNLVTQFSPSLLKSEGVPVYRCVQHEGEFVLTFPRAYHAGFNCGFNCAEAVNVAPIDWLPIGQDAVELYRKQARKITVSHDKLLLGAAREAIRAQWDILFLKRNTADNLRWKSMCGLDSTICKSLKARINLELVQRQNICSPSQSRKMDAEFDSTERECALCYYDLHLSASGCPCCPEKYTCLAHAKQLCSCDWDKRFFLFRYDVNELNLLADALGGKLSAIHRWGVSHLGLSLSSCVKREKDQDSKTLHRVTEGPRRSYMSQASTVSLAPSVVCKEQNNNGNKMLNTSSLETDTSGPFSEPIKSGNVSLQKETQMRNEVLCTLNNSVSPEGHKGSLNFPVPSGQSFSSNFATRSLSTSGESMKTAYGLAVFEGSRESSRSGNCISSVGVHHNIPPIMVDQGNNMNPSMESSNNSHRLMASNTNATQCHSYKDQMHVTPETRACASSSQPFVRTVLRAQSVSKEASAGVFGSKPLINSSLVKNTYGGSSSCGAHLGLPNFGNQQPSDGCLQRKSESLCGSEARGQPVLVVQPALENRNRNGGAHKGPQIANVMHRFKSLVEPLEIGVVLSGRLWSSSQAIFPKGFRSRVKYFSIVDPTQMAYYISEILDAGPQGPLFMVTLENCLGELFINVSPTKCWSMVRERLNMEIRRRLSMGRTNLPALQPPGSVDGFEMFGLLSPAIVQAIEARDRDHICTEYWRSRSHIVTEDRDSRQMGPLQAQGPLHALRELFQRANRNELLALRSLLVSNNNLDDFSRQQAAQILDEEMAKQWR

SEQ ID NO: 89 - protein, 954 aa, O. Sativa
MVSSRDPGEEASAPPPRPPRRGEKRRMRGRTPSPEPASAPQTNGKWHPHESYRPEIDDAPVFTPTEEEFKDPIRYITSIRPQAEKYGICRIVPPSSWRPPCSLKEKNFWECTEFNTRVQQVDKLQNREPTKKKSQPRVQKKRKRRKRLRFGMTHRRPSANTSEDCADADEKFGFQSGSDFTLDEFQKYADEFKQQYFGIKGSDEIPLSEIKKKKKNWQPSVDEIEGEYWRIVVCPTDEVEVDYGADLDTSMFSSGFSKLSSDSNRRDPYGLSCWNLNNLPRIPGSVLSFETEDISGVVVPWLYVGMCFSSFCWHVEDHFLYSMNYMHFGEPKVWYGVPGADAVKLEEAMRKNLPRLFEEQPDLLHELVTQLSPSVLKSEGVPVYRVVQNPGEFVLTLPRAYHSGFNCGFNCAEAVNVAPVDWLPHGQCAVELYREQRRKTSISHDKLLLKTANEAVRQLWMNLSDCKSEQGVYRWQDTCGKDGMLTSAIKTRVKMEKAARGGNMALRYKKMDGDYDSADRECFSCFYDLHLSAVSCQCSPNRFACLNHANILCSCEMDRKTALLRYTIEELHTLVAALEGDPTAVYQWGQNDLGLVCPSGSTQYKKMDLGENTEFPDSATNVNHGCSLGSQDQYHYDPAKPAGYQQEKGIQIASEKHDKNKMVVNLESPATASNPSRSKSDCSGSLSLNHSSELPSSRIQTGNSTLASITTEKLFGVDIKSNLAQSSDGQVSQLAKPSSSQTDEVSKPAIAKYTVELLDSGTMMIGKKWCNQQAIFPKGFKSRVTFHSVLDPTRTCCYISEVLDAGLLGPLFRVTVEGLPEVSFTHTSPMQCWDSVRDRVNEEIAKQISFGKSGLPDFLSCNSLNGLEMFGFLSSPIIKEIEALDPCHQCLDYWLSRVSSVGTELPSESVMAAMVNDSTNPPIKLLGIEINRRESEQSSSFNNSCVRRSHLAGC

SEQ ID NO: 90 - protein, 1038 aa, B. Distachyon
MVFSSASPMEEKSGGLGRPPRREKRRMCNPAASSEPSSMAMTLQDLCSSRSCEEDGGGTATTHGKWNPYESHRPEIDDAPVFTPTEEEFEDVIGYITSICPLAEKYGICRIVPPPSWRPLCPLKEKSFWHCTEFNTRVQEVDKLQNREPTKKRTQPRVQKKRKRRKRLRFGMSRRRPSANASESADSGEKFGFQSGSDFTLEEFQKYADEFKQQYFGMKGSDEISLSEIKNRKEIWRPSVEEIEGEYWRIVVCPDDEVEVDYGADLDTATFSSGFNKLSLSDANKQDPYCLSCWNLNNLRRQHGSVLSFETEDISGVVVPWLYVGMCFSSFCWHVEDHFLYSLNYMHFGEQKVWYGVRGDDAVKLEEAMKRNLPRLFEDQPDLLHELVTQLSPSVLKSEGIPVYRVVQNPGEFVLTLPRAYHSGFNCGFNCAEAVNVAPVDWLPHGQCAVELYREQRRKTSISHDKLLLKTAQRALRQLWINLGNCRCGQTEYVWLDTCGKNGMLTSAVKTRVKMEGAARETNAVLQYKKMDQDYDSTDRECFSCFYDLHLSAVSCKCSPDRFACLNHANLLCSCEIGRIFLLYRYSMEELNALVAALEGDSAALYQWIQFDQDFVSQSGSMQQNNMDFSKSKELCESATDLNIGCGFDDCHDLDKTGQQKEKKVQNKCADVNMENKSSPRIKNVLVRSSDTSNAACFSISSCTASEKHDKDKIAIDSESIVTRINPPVSNSQFSQSSKCLSELSCPKGNSTPSSKTTKKLFGVDIGCNMTKTSDAQVSQLVKPSTSQPDEVSRPTILWSTVEPLEYGTVMVGKNWCNHQAIFPKGFRSRVTFHSVLDPTKTCGYISEVLDAGLFGPLFKVTVEDLPEISFTHTSPMECWNSVRDRVNEEIEKQHVVGKSGGCAILSTNSVNGLEMFGFSFPPIIQAIEALDPYHRFLEYWLSKHMPPVKELPSGSVMAEAVNGMNNSPIRLPGVDITSNESEHSSFRHKSCAEEVKLDRLLKKAKLPEEPELIDTNKVFSSREHSSSNWSGSRHSAG

SEQ ID NO: 91 - protein, 1047 aa, P. trichocarpa
MEQFKSPAYSHVKEDHSIKQSWRSDNTPKGPRSPQNQKVTARWDPVEACRPLIDDAPVFYPTVEEFEDTLGYISKIRAKAELYGICRIVPPPSWSPPCRLKEKDIWEHAKFSTRIQYVELLQNREPMRKKSKSRKRKRSSRMGTTRRRKRRLTNSSSEGNVASETDETFGFHSGSDFTLEEFEKEAAYFKECYFGTKDLMDDGNETQKWEPSVEDIEGEYWRIVEKPTDEVKVLYGADLETATFGSGFPKASALMTEGDSDQYVVSGWNLNNLPRLPGSVLCFEGCDISGVLVPWLYVGMCFSSFCWHVEDHHLYSLNYLHWGDPKIWYGVPESHASNLEDAMRKHLPDLFEEQPDLLHGLVTQLSPSVLKAEGVPVYRVVQHSGEFVLTFPRAYHSGFNCGFNCAEAVNVAPVDWLAHGQHAVELYSEQRRKTSISHDKLLMGAAQEANRALRELLLLGKETPENLRWMSVCGKDGVLTAAVKTRVKMEEERIKSLPTNLKLQKMEKDFDLQKERECFSCFYDLHLSSASCKCSPERFACLQHASHFCSCEIDHRYVLLRYTMDELNTLVDGLEGESYGLKDCPDEQGLVSLGDNGTRVPELELKGEEFQTNYSKRKESPHCSKKTEEKLSTKGSCSFNSNTSSEVIQSESYHNSFPVMKNKDKVKQEGCIDLNIDVMSIDQESKHLLESDGCDNKAISYVKETHGSPCMQETPGSSDAAKEQDREQAVGDCEAKLQELSNKNDPSYPMFTQDTCASRNKLFGVDLSRSHSVRPAKSFKTEMNKGGLDVRPATNQSIPVKKLNPCVEPINVGSVMFGKLWCCKQAIFPKGFKSWVKFFNVHDPIKKCSYISEVRDAGPLGPLFKVSLEKFPGETLAADVSIQKCWEMVVQRLNDEIGRRNSLGERNLPPSQSINGIEMFGFLSPPIVQAIEALDPDHRCVEYWNHRLVNLRNTREAKQPPFGSSCCLTKMKEKIDINLLTQEPGSLFIGGHRSVDEDVQHVLRGLFKKASQEELKTMHRILHSDAQSAERREAFTTLMEEIQKTSR

SEQ ID NO: 92 - protein, 964 aa, B. Napus
MESSASPAAESKAMEVDSEKQSIKRDSSSPGPDSTPPSPKKVASPAAESLAMEVDSEKQSVKGDSSPEPDSEKQEIKGDRSPEPDSAPPSPKVSPKWNPLEACRPSVDDAPIFYPTNEDFEDPLAYIEKLRSRAELFGICRIVPPVAWKPPCPLKEKEIWEKSKFPTRIQLIDLLQNREPIQKSPKSKKRKRGRVSKVGYSRRRRDSGSDDDDSTEDAEGKFGFQTGPDFTLEEFQKYDEEFKESYFQLENGSKASENKKFKPKVKDIEGEYWRIVEQATDEVEVYYGADLETKKFGSGFPKYSPDSRKSLEEHQYSTSGWNLNNLSRLPGSVLSFEKCDISGVIVPWLYVGMCFSTFCWHVEDHHLYSLNYLHTGDPKVWYGIPGSHAASFENAMKKLLPDLFEEQPDLLHQLVTQLSPSILKEQGIPVYRAVQRSGEFILTFPKAYHSGFNCGFNCAEAVNVAPVDWLVHGQDAVEGYSKQRRKSSLSHDKLLLGAAMEAIYYLWELAVTRKKTPVIARWKRVCSEDGLLTKAVKKRVEMEAERLNQLGDSYRVVKMEGDFDIKRERECFLCFYDLHLSASSCKCSPNRFACLTHARDLCSCESKDRFVLLRHTLDELRSLVRALEGYPDAIEAWARISREQNPSRQQSAKEALDFKSSTSCSKSRGSSKTQQQNNLQLGSGGLQSDKEVQLKQDGDQDVHGITTKSDEKKVAVKSQNPHSVSDVGCSEPDAATNRLSHSVELLKSGSLVVKKQWCSKQAIYSKGFKSRVKFISVLDPTKLTNYISEVLDAGLAGPLFRVSLEECPSENFSNVSAEKCWQMVIQRLKLEIIKRCDQPASSLTALQALESIGLEMFGFLSPHVIQALEALDPKHQLEEYWNQKTAKVFGVELTKEGEKDNDDKEKGGASDPSMDRDTRLLRGLLKKATPEELAMMHGLLCGETRNTELQEELSSLVDKMEKSP

SEQ ID NO: 93-131 - skipped (39 entries)

SEQ ID NO: 132 - protein, 1133 aa, A. thaliana
MVSETTTNRSTVKISNVPQTIVADELLRFLELHLGEDTVFALEIPTTRDNWKPRDFARVQFTTLEVKSRAQLLSSQSKLLFKTHNLRLSEAYDDIIPRPVDPRKRLDDIVLTVGFPESDEKRFCALEKWDGVRCWILTEKRRVEFWVWESGDCYKIEVRFEDIIETLSCCVNGDASEIDAFLLKLKYGPKVFKRVTVHIATKFKSDRYRFCKEDFDFMWIRTTDFSGSKSIGTSTCFCLEVHNGSTMLDIFSGLPYYREDTLSLTYVDGKTFASAAQIVPLLNAAILGLEFPYEILFQLNALVHAQKISLFAASDMELIKILRGMSLETALVILKKLHQQSSICYDPVFFVKTQMQSVVKKMKHSPASAYKRLTEQNIMSCQRAYVTPSKIYLLGPELETANYVVKNFAEHVSDFMRVTFVEEDWSKLPANALSVNSKEGYFVKPSRTNIYNRVLSILGEGITVGPKRFEFLAFSASQLRGNSVWMFASNEKVKAEDIREWMGCFRKIRSISKCAARMGQLFSASRQTLIVRAQDVEQIPDIEVTTDGADYCFSDGIGKISLAFAKQVAQKCGLSHVPSAFQIRYGGYKGVIAVDRSSFRKLSLRDSMLKFDSNNRMLNVTRWTESMPCFLNREIICLLSTLGIEDAMFEAMQAVHLSMLGNMLEDRDAALNVLQKLSGENSKNLLVKMLLQGYAPSSEPYLSMMLRVHHESQLSELKSRCRILVPKGRILIGCMDEMGILEYGQVYVRVTLTKAELKSRDQSYFRKIDEETSVVIGKVVVTKNPCLHPGDIRVLDAIYEVHFEEKGYLDCIIFPQKGERPHPNECSGGDLDGDQFFVSWDEKIIPSEMDPPMDYAGSRPRLMDHDVTLEEIHKFFVDYMISDTLGVISTAHLVHADRDPEKARSQKCLELANLHSRAVDFAKTGAPAEMPYALKPREFPDFLERFEKPTYISESVFGKLYRAVKSSLAQRKPEAESEDTVAYDVTLEEAGFESFIETAKAHRDMYGEKLTSLMIYYGAANEEEILTGILKTKEMYLARDNRRYGDMKDRITLSVKDLHKEAMGWFEKSCEDEQQKKKLASAWYYVTYNPNHRDEKLTFLSFPWIVGDVLLDIKAENAQRQSVEEKTSGLVSI

SEQ ID NO: 133 - protein, 1134 aa, A. lyrata
MVSETTTNRSTLKISNVPQTIVADELLRFLELNLGEDTVFALEILTTRDNWKPRDFARVQFTTLEVKSRAQLLSSQSKLLFKTHNLRLSEAYDDIIPRPVDPRRRLDDIVLTVGFPESDEKRFCALEKWDGVRCWILEEKRRLEFWVWENGECYKIEVRFEDIVETLCCCVNGDASETNAFLLKLKYGPKVFKRVSGPHIATKFKSDRYQFCKEDFDFMWIRTTDFSGLKSIGTSTCFCLEVHNGSTMLDVFSGLPYYREETLSLTFVDGKNFASVSQIVPLLNAAILGLEFPYEILFQLNALVHAQKISLFAASNMELINIFRGLSLETTLVILKKLHQQSSICYDPLFFVKTQMQSVVKKMKHSPASAYKRLTEQNIMSCQRAYVTPSKIYLLGPELETANYVVKNFAEHVSDFMRVTFVEEDWSKLPANALTVNSKEGYFVKPFRTNIYNRVLSILGEGITVGPKRFEFLAFSASQLRGNSVWMFASNEKIKAEDIREWMGCFRKIRSISKCAARMGQLFSASRQTLNVRAQDVEQIPDIEVTTDGADYCFSDGIGKISLAFAKQVAQKCGLSHVPSAFQIRYGGYKGVIAVDRSSFRKMSLRDSMLKFDSNNRMLNVTRWTESMPCFLNREIICLLSTLGIEDAVFEAMQAVHLSMLGNMLEDRDAALNVLQKLSGENSKNLLVKMLLQGYAPSSEPYLSMMLRVHHESQLSELKSRCRILVPKGRILIGCMDEMGILEYGQVFVRVTLTKAELKSREQSYFHKIDEETSVVIGKVVVTKNPCLHPGDIRVLDAIYEVNFEEKGFLDCIIFPQKGERPHPNECSGGDLDGDQFFVSWDEKLIPSQMDPPMDYAGSRPRIMDHDVTLEEIHKFFVDYMISDTLGVISTAHLVHADRDPEKARSQKCLELANLHSRAVDFAKTGAPAEMPYALKPREFPDFLERFEKPTYISESVFGKLYRAVRSSLAQRKPEAESDGTLTYDATLEEAGFESFIETAKAHRDMYAEKLTSLMIYYGAVNEEEILTGILKTKEMYLARDNRRYGDMKDRITLSVKDLHKEAMGWFDKSCEDEQQKKKLASAWYYVTYNPSHRDEKLTFLSFPWIVGDVLLDIKAENAQRQSGEKPTSGIVSI

SEQ ID NO: 134 - protein, 1117 aa, C. Sativus
MAQPERSTLRVSNVPESAIAQDLLNFLNSKLGPDSVFAIEIFTERKNWKSRGSGRVQFTTLEAKAKAMSLSVQNSLVFGTQNLRFSLINDDIVVRPVHATNRTENGVLHVGFMLKEERMSVLESWEGVKAWIMPERRRIEFWIWHEQECYKLEVMFEEILETTGHCLGEEKLNALLLKLKYAPRIYKKISGSNMASRFSSTRYRLCIEDYDYLWVRTTEFSPMRSVGQSTSFCWEVEEDLQASDIFSCFPFYKETQKDIVLEDGEEFCSTSEIVPLIKSGLGSNLAYEVEYQLNSLVHMQKISLSAANQDLIDFLCTLDIDTALNVLQRLHQLKFVCYDPLSFLKTQLHVYKRNCKSLPPSSQKRLSNNVMNCYRVLVTPSRIYCLGPELETSNYVVKNFSSYASDFMRVTFVEEDWSKLPAGAVTTSIQRGILSKPYRTEIYHRIMTVLRDGIVIGAKRFEFLAFSASQLRSNSVWMFASSDNLKAEEIRQWMGCFEKIRSISKCAARMGQLFSSSTQTLVVPTRDVEIIPDIEVNTDGIDYCFSDGIGKISLSFARQVADKCGVNHIPSAFQIRYGGYKGVIAVDRNSFRKLSLRDSMLKFESKNKMLNVTKCCDSMPCYLNREIATLLSTLGVKDESFEALQQEQLHLLKRMLTDKDVALNVLENFHGADSNNILVQMLNHGYEPNIEPYLSMMLQAHYWNLFSDLRSRCRIFVPKGRILLGCLDETGILNYGQVYACITLTKSELQSRNQNYFHTIDETKSILLGKVVVTKNPCLHPGDVRVLEAIFHVELEEKGLVDCLIFPQKGARPHTNECSGGDLDGDLYFISWDENLIPPKTEAPMDYTGRRPRIMDHDVKLEEIQKFFVDYMINDTLGAISTAHLVHADREPKKALSAKCLELAALHSMAVDFAKTGAPAEMPRVLKPREFPDFMERFDKPMYISSNVLGKLYRAAVKSIEQERSRLVWSEEAARAIYDYDLEVDGFEAFLEIAETYKEMYIEKMSILMNYYGAEYEDEILMGDLRSRASYLQRDNRKYGDMKDRILLSVKNLRKEVKEWFENSCDPLNRRMMASAWYHVTYHPSYFKEDMFYFSFPWAVSDVLLNIKAMNSKRHQA

SEQ ID NO: 135 - protein, 1127 aa, V. Vinifera
MAVGERPTVKVSNIPKTAIAKELWSFLESKLGPNTIYALEIATEHKNWKSRGFGRVQFETLQAKRAADLLSLQGDLVFRGSSLSISATFDDIIVRPVEPRNQVDSGVLHVGFLVEDDCMLVLESWEGVKTLVMPERNRVEFWVDKDGERYKLEVPFDDVLESSACCLGGGKVNALLLKLKYAPKIFQKFAGPNIASKFSADRYHISKEDAEFLWLRTTDFSSIKSLGQSTSFCWEIKEGFPALDIFASFPYYKDLTELTLEQGEGFCSDSGLVPLVKCESGPKLAYEILFQLNSLVHAQKISLAAVDTDLIEILSNLPVDTAIMILQKLHKRKSTRYDPISFIKAQAHIINMNIKNLPPSSHSRLTNNNVMSCHRVLVTPSKIYCLGPELESSNYVVKHYAAYASDFVRVSFVEEDWSKLPSNALSMSIRKAFFADPFRTEIYHRILSILREGIVIGAKRFQFLAFSASQLRSNSVWMFASNDKVRVDDIREWMGCFKKIRSVSKCAARMGQLFSSSVQTLPVPVQDVEVIPDIEVTSDGFGYCFSDGIGKISLSFAKQVAQKCGLHQTPSAFQIRYGGYKGVIAVDRNSFRKLSLRSSMLKFESQNRMLNVTKWSESTPCYLNREIVSLLSTLGVEDENFEALLNEQMHLLDKMLTNRQAALDVLESMGGIDNKNILAKMLLQGYEPNVEPYLSMMLQAYRESQLSDIRTRCRIFVPKARVLIGCLDETGILNYGQVYVRVTMTKAEHKCRNQSFFQKVDDTTSVVIGKVIVTKNPCLHPGDIRVLDAVYEVELEEKGLVDCILFPQKGERPHPNECSGGDLDGDQFFICWDEGLIPSQTEAPMDYTSRRPRIMDHDVTLEEIQKFFVDYMINDTLGVISTAHLVHADREPEKARSKKCLELATLHSMAVDFAKTGAPAEMPRVLKPKEFPDFMERVDKPMYISNGALGKLYRATIASRVNEKSSFVWSGTIPGAAYDHDLEVDGFETFLEIAKLHKEMYAEKMATLMNFYGAESEDEMLTGNLRNKLMYLQRDNRRFTEMKDRILISVKSLQKEAKEWLYGSCKPHQHQKMASAWYHVTYHSTFSSQTPNFLSFPWIVGEVLLVIKSANSRKAETSKDNCIQQNM

SEQ ID NO: 136 - protein, 1123 aa, M. Truncatula
MVIPSSETPTVRVTNIPHTATANDLLRYLETTVGRSSVFALEIFSDYTNWKSRGVGRVQFETLEAKSKALTLAENKKLLLSSHFLCLDASSDDIIPRPALPRNRINNGALYAGFPIGPDCMSVLQSWEGVRGWVMPERQRLDFWVTHGDQCFKLEIPFENILECDGYCSDEGSKPNALLLKLRYGPRIYQKMAGPNVAAKFKDDRYRFCKENFEFMWVRTTDFSTLKSIGHSTSFFWEIVEESFDSDVFRSFPLYRENLKDLSLEDGEKFCSPTETVPLVKCRLDSKLPYESLFQLNSLVHTQKISLASVNDELIDLLASLDAETKAVIFQKLHKMNSTCYEPLKYVRTQLHVLSIKKKSVLPSQQKRLVDNNIMSCHRALITPSKIYCLGPELETSNHVVKHFAAYASDFMRITFVEEDWSKLPNNAISITLKKGMFSRPLRTEIYKRVLNILRDGILIGSKRFEFLAFSASQLRSNSVWLFASNDKVKAADIREWMGSFNNIRSVSKCAARMGQLFSSSRQTFEMAPQDVDLIPDIEITSDGIDYCFSDGIGKISQSFARQLAEKLKLDENRIPSAFQIRYGGYKGVIAVDRHSFKKLSLRKSMLKFESKNRMLCVTKWSESMPCFLNREIISLLSTLGIKDEALLALQEDQLQLLGKMLTDKEAALDVLESLNGADSNSILVKMLHRFYEPNSEPYLSMMLKAHYTYQLSDLKSRCRIFVPKGRVLIGCLDETGLLNYGQVFVRITVAKTKEKFGDENLRNVDGDDSTRIIVGKVVVTKNPCLHPGDIRVLDAVYSEELEEKGLRDCLVFPQKGHRPHPNECSGGDLDGDLFFISWDKDLIPAQTENPMDYTGRRPRIMDHKVTLEEIHQFFVDYMINDTLGAISTAHLVHADREHDKAKSRKCLELAELHSMAVDFAKTGAPAEMPRSLKPREFPDFMERFEKPMYISKGVLGKLYRATIDSNLQVRFDMVMSEKFAKEAYDHQLEVDGFEVFLETALSHRDMYAQKMISLMSFYGATTEDEMLTGNLQNRASYLQRDNRRYGDMKDRILISVKDLQLEAKEWFESDCQPHEYQLMASAWYHVTYHPKYYIESSTFLSFPWIVGDILLHIKSANAPSVP

SEQ ID NO: 137 - protein, 983 aa, R. Communis
MEISFEDVLETVGCRLGGDTLNAILLKLKYGARIYKKISGPDIASKFSADRYHMCKEDFDFIWVRTTDFSSVKSVGQSTSFCWEIEEGLEASDIFKSFPYYTEAREEVILEDGEEWGSASEIVPLVKCGSDSKLPYEILFQLNSLVHTQKISLAAVDTNLITTLGSLTIDTATMILQKLHKLAVTCYDPLAFIKKQLHVPGRNLKRPFFSSSKNLVNHNIMSCHRALITPSKIYCLGPELESSNYVVKNFASYASDFMRVTFVEEDWSKLPANAISMSIQRGIFAKPFRTGIYHRILSILRDGIVIGAKKFEFLAFSASQLRSNSVWMFASNDKKKAEEIREWMGCFNKIHSISKCAARMGQLFSSSKQTFIVSPQDMEIIPDIEVTSDGINYCFSDGIGKISLSFARQVAQKCGLNRTPSAFQIRYGGYKGVIAVDRNSFRKLSLRDSMCKFESENRMLNVTKWSESMPCYLNREIITLLTTLGVKDEIFEGLQQQQLQLLNRMLTNRESALNVLENLAWANCKNILIKMLVQGYEPNVEPYLSMMLQAYHENLLVELRSRCRIFVPKGRILIGCLDETRILDYGQVYVRITMTKAELQDADQASFHRVDETTAVVTGKVIVTKNPCLHPGDIRVLEAVYEVELEEKGLVDCILFPQKGERPHPNECSGGDLDGDQFFISWDKGLIPGETESPMDYQGRRPRKMDHDVTLEEIQKFFIDYMINDTLGAISTAHLVHADREPDKARSSKCLQLAELHSMAVDFAKTGAPAEMPKALKPKEFPDFMERIDKKMYISGGVLGKLYRGTLDSTRQQRSKFVWTENIAEATYDHDLEVKGFEEFVEIAISHKDMYVEKLSGLMDYYEAKKEDEILTGNLQNKAMYLQRDNRRYGDTKDRILISVKSLQKEAKEWFESCCQAKEKQRLASAWYHVTYHPSYFQEGITCLSFPWIVADILLNIKSANSKNLKTSSVPCIEDATKEAEDN

SEQ ID NO: 138 - protein, 1121 aa, G. max
MGTTTTTTLSNTVRVSNIPQSATAKDLLDFLESTVGPSTVFALEIFSDNPNWKSRGFGRVQFETLDARSRALSLSQLNHLLFHRHFLRLSETDADIIFRPQHRLHNGVLYAGFVLSDHRMSVLESWEGVAGWVLPLRKRLDFWVWHNGDCYRLEFLFEDILESHGYCLGEDAKLNALLLKMKFGPRIYKKKTGADVAAKFRGDRYRFCKEDFEFLWVRTTDFSPLKSIGHSTSFCWEIVEEHLALDVFKSFPLYKENLRDLALEDGEEFCSSTEAVPLVKRASQSKLPYEALFQLNSLVHTQKISLASVDDELIDLLAGLDEETRAVIFLKLHKMSFTCYEPLKFVKTQLHVLSNKKKGLPQSSQKRLTDSNIMSCHRALITPTKIYCLGPELETSNHVVKHFASHASDFMRITFVEENWNKLPTNAVSTGVQKGLFSKPLKTEIYKRILTILRDGIVIGSKRFEFLAFSASQLRSNSVWLFASNDNLKAADIREWMGCFNNIRSVSKCAARMGQLFSSSMQTFEVVSQDVEIIPDVEVISDGVSYCFSDGIGKISQSFARQVAQKLKLDHTPSAFQIRYGGFKGVIAVDRRSFRKLSLRSSMLKFESKNSMLCVTKWSESMPCFLNREIISLLSTLGVKDEVLLAMQHDQLDLLGRMLTDSKAALEVLESLNGADSKSILVKMLHEFNEPNSEPYLSMMLKAYYAYQLSDLKSRCRIFVPKGRVLVGCLDETGLLNYGQVFVRITVTKTREKFGDENLRKVDGDDNTCIIVGKVVVTKNPCLHPGDIRVLDAIYSEELEEKGLRDCLVFPQKGHRPHPNECSGGDLDGDLFFISWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYRAIIESQMQIRYSFVWSEKHAEEAYDRSLEVNGFEAFLETASTHKEMYAEKMSSLMDFYGAETEDEMLLGNLQNRASYLQRDNRRYGDMKDRILLSVKNLQREAKEWFETSCEPHEYKPMASAWYHVTYHPSYYCRESPCFLSFPWIVGEILLQIRSVSKGVHK

SEQ ID NO: 139 - protein, 1127 aa, Z. mays
MSTAAPAPGSTATVRVSNIPASAIAAELLAFFDSAVTIAGATFACEIVAAHRGWLSRGHGFVQFDSSAAATHAIDLASSGRLPPFLGSCLSVSPARADLLPRAPDLSLRAASASLILGNRVAERELEVAYSCDGVRAEVIPRMRRVDLYLKHDSQSYKLEVLFEDINECFGCHLDGTGAILLQLTYAPRIHIAISGSTVKSRFTDDRFHACKEDAKFAWVRALDFTPNSSFGECSTLVLKLSKGASVSYILESLPFSGELGELAIASMDVFGSSSNVVPLVDCPNGFSVPYEVLFRLNSLVHMGKLVARHVNADLFKVLEDLSIDTLRRIFEKMSKLKSTCYEPLQFIRHEAHSMNMRKKALSNKRESGKLMRCYRIHITPSKIYCLGPEEEVSNYVVKYHSEYASDFARVTFVDEDWSKLSPNALSARTEQGFFSKPLKTGLYHRILSILKEGFCIGPKKYEFLAFSASQLRGNSVWMFASNSSLTAENIRRWMGHFEDIRSVSKCAARMGQLFSSSRQTFEVSSYDVEVIPDIEVTTDGTKYIFSDGIGKISTRFARQVAKLIGLDPAHPPSAFQIRYGGYKGVITIDPTSFFNLSLRPSMKKFESKSTMLNITNWSKSQPCYVNREIISLLSTLGIKDEVFESMQQDDMHESDGMLTNKEAALSVLGKIGGGDTKTAADMLLQGYEPSSEPYLLMILKAHRANRLTDIRTRCKIHVQKGRVLIGCLDETCKLEYGQVYIRITKNHKEQKYSEQPFFCNDDGKTAVIVGKVAITKNPCLHPGDVRVLEAVYDPGLDARGLIDCVVFPQRGERPHPNECSGGDLDGDLFFITWDDKLIPEKVDAPMDYTATRPRIMDHAVTLEEIQKHFVSYMINDTLGAISTAHLIHADRDPLKARSPECVQLAALHSMAVDFAKTGAPAEMPLALRPREFPDFMERWERPMYVSNGVLGKLYRAALRHEEDAEALLPAGPPSCVYDPDLEVAGFDEFLDAAEERYEAYAERLGALMTYYSAEREDEILTGNIRNKLVYLRRDNKRYFEMKDRIIAAVDALHAEVRGWLRACKEDDASRVASAWYHVTYHPDRRGEKRFWSFPWIICDTLLAIKAARRCRKRVEDAAVPMDCDGS

SEQ ID NO: 140 - protein, 1128 aa, S. Bicolor
MSMAAPAPGATATVRVANIPASAIAAELLAFFDSAVTTTGAAFACEIAAAHRGWLSRGHGSVQFDSSAAAIHAIDLASSGRLPPFLGSCLSVSPAHADLLPRAPDLSLRAADAGLILGNRVAERELEAAYSWDGVRAEVIPRKRRVDLYLKQDSRSYKLEVLFEDIRECFGCHLDGTGAILLQLTYAPRIYTAISGSTVKSRFTDDRFHACKEDAKFAWVRALDFTPNNSFGECSTLVLKLSKGVPVSDILESLPFSGELEELAISSMLAFGSSSNVVPLVDCPNGFSVPYEVLFRLNSLVHMGKLVARHVNADLFKVLEELSIDTLRRIFEKMSKLKSTCYEPLQFIRHEAHSMSKSKKAFLSNKKDGGKLMRCYRIHITPSKIYCLGPEEEVSNYVVKYHSEYASDFARVTFVDEDWSKLSPNALSARTEQGFFSTPLKTGLYHRILSILKEGFCIGPKKYEFLAFSASQLRGNSVWMFASNNSLTAESIRRWMGHFEDIRSVSKCAARMGQLFSSSRQTFEISSYDVEVIPDIEVTSDGTKYIFSDGIGKISTRFARQIAKLFGLDPAHPPSAFQIRYGGYKGVITIDPTSFFNLSLRPSMKKFESKSTMLNITNWSKSQPCYVNREIISLLSTLGIKDEVFESMQQDDMHESDGMLTNKEAALSVLGKIGGADTKTASEMVLQGYEPSSEPYLLMILKAHRANRLTDIRTRCKIHVQKGRVLIGCLDETCTLDYGQVYIRITKNRKEQKYSEQPFFCNDDGKTAVIVGKVAVTKNPCLHPGDVRVLEAVYDPALDARGLIDCVVFPQRGERPHPNECSGGDLDGDLFFITWDDKLIPEKVDAPMDYTATRPRIMDHAVTLEEIQKHFVNYMINDALGVISTAHLIHADRNPLKARSPECLQLAALHSMAVDFAKTGAPAEMPVALRPREFPDFMERWERPMYVSTSVLGKLYRAALRHEENAEALLPAGPPRCVYDPDLEVAGFDKFLDTAEEQYEVYAEKLGTLMTYYSAEHEDEILTGNIRNKLVYLRRDNKRYFEMKDRIIAAVDALHAEVRGWLRARKEDDASKLASAWYHVTYHPDRRGEKRFWSFPWVACDTLLAIKAARRCRKRVEDAAAPMDCDAS

SEQ ID NO: 141 - protein, 1027 aa, O. Sativa
MGVKTLQVSGFALDDSADYVKDLLERIVGCGNVYAVKLRHPKNVTATSRAYAIVQFQTEEHASLVKNAAQRKILRRGHYYLKVHPSDRDIVPRPRVSMFKLEDVTLHFGCLLKETILSALWSRKGVSVEFGFNLKKIYFYLQLPNSSIEYKLELSHESIWEIQLQRPPKSQTKFLLIQVQAAPKIYEQTPRRSGVMYEDPLFNYFRDHTDDQWTRTTDFTSSSSIGQSYILCLEVPRRCDLPNIRDYFFYYHEYNHDFECRSGGYPYSSDTRFVPIVKSRGYVPYEILFKINHLVQNGTLSGPTVDDSFFRLVSPAFVPIDHIKRALEMMSYLKKTCLNPTMYFYGPEINVSNRVVRNFSSDIENFLRISFVDEDCEKLRATDLSPRSASGHDANRTALYKRVLSVLSDGITIGGKNFEFLAFSSSQLRDNSAWMFASRQGLAASDIRTWMGDFRNIRNVAKYAARLGQSFSSSTETLKVQKYEVEEISDIKNGTQHVFSDGIGKISSAFANEVAMKCNLKRFAPSAFQIRYGGYKGVVAVDPTSRWKLSLRKSMLKFQSDNITVDVLAYSKYQPGFLNRQLITLLSTLGVRDSVFEQKQEEAVNQLNKMVTDPQAAIEAIELMPMGEITNAVKELLLCGYQPDDEPYLSMLLQTFRASKLLELKTKSRILIPKGRAMMGCLDETRTLKYGQVFIRATSGVNDNDRPHPNECSGSDLDGDIYFVSWDPSLIPPRMVTPMDYTPAPTETLDHDVTIEEVEEYFTNYIVNESLGMIANAHVVFADKEDLKAESSPCIELAKLFSIAVDFPKTGVPALIPPELHVKEYPDFMEKLDKVTYESKGVIGKLYREIKKHTPHIKHFTREVARRSYDTDMIVDGYEDYITEAMALKDEYDFKLGNLMDHYGIKSEAEIISGCILKMAKNFTKKSDADAIRLAVRSLRKEARSRFSEMSLDDNGHGHDASEAKASAWYHVTYHPEFWGCYNEGYERPHFISFPWCIYEKLLRIKQRRKFVRKMQPELFSLHNLRI

SEQ ID NO: 142 - protein, 1140 aa, B. Distachyon
MAAAVPEPISTATVRVSNIPRLAVAAELLAFFDSAVAAVGTTFACEIVAAHRGWQSRGHGTVQFDSAATASLAAELASSGRLPRFLGSPLSVSPAPADLLPRAPAPSLRASGARLLVGNRVAERELEMAETLDGVRVEVIPGKRRVDLYLTHDSHRYKLEVLFEDIRNCFRCSLDGTSAILLQLTYAPRIHTAFSGPAVYSRFKDDRLHACKEDAKFTWVRALDFTPNQSFGKCSTLVIKLDEDALMSYILNTLPFSGVLGELAISSMDVVGPSSKAVPLVDCPHGCSVSYEVLFRLNSLVHMGKIVAKHVNAKLFAFLEQVPLHISRRIFEKMSKLESTCYEPLQFIESELKLTHNALLSSKREGEGKLMRCYRIHITPSKIYCLGPEEEASNYVVKHHSEYASDFVRVTFVDEDWSKLSVNAISARIEQGFFSQPFKTGLYYRILSILKEGFIIGPKKFEFLAFSASQLREGSVWMFASNDSLNAESIRRWMGHFEEIRSVSKCAARMGQLFSSSRQTVEVRPWDVEEIPDIEVTTNNTKYIFSDGIGKMSVRFAREIAYRIGLDHTNPPSAFQIRFGGYKGVIAVDPSSFRNLSLRPSMRKFESDCRMLNITSWSKSQPCYVNREIISLLSTLGIRDEVFELMQQDDMRELDEMLTNKEVALSVLGKIGSAETKTAADMLLQGYEPISEPYLLMILKAHQDNRLTDIRSKFKIHVPKGRVLLGCLDETGKLKYGQVYIRITKNNKEQKENEQPYFSEDDGKTVTLVGKVAVSKNPCLHPGDVRVLEAVYDPGLHAKKLVDCVVFPQRGERPHPNECSGGDLDGDLYFVTWDDKLIPEKADAPMDYTGARPRIMDHVVTLEEIQQHVVNYMLSDSLGAISNAHLIHADRDPMKARSPECLQLAALHSMAVDFAKTGAPAELPRSLRPREFPDFMERWDKPMYISNGVLGKLYRAAVSRMESSHALASQVQSSPTYDRELAVPGFEEFLEDAEKHYDLYVEKLTTLMNYYGAEHEDEILTGNIRNRLLYLRKDRKRYSDMKDRIFDSVNALHEEVRGWFKNCLKAEEEASRVASAWYRVAYHPDHRRPEKKQFWSFPWIICDKLLAIKATKSNRCRKLVGVATGVDPMDCVPAKRMRRI

SEQ ID NO: 143 - protein, 1110 aa, P. trichocarpa
MEVVAERPSVRVTNIPQTITAKEILQYLVAQLGKDSVFAIEISTVRKNWNSRGFGRVQFSSLEVKHEALSLSLKNKLVLKSQNLKLSETYDDIIPRPVKDQNRMENGVLYVGFMKKETTLCVLEYWEGVRGWFMPERRRIEFWIRVGQEFRYKLVVEFEDILEAVGYPLDGDKVNAVVLKLRYGPRIYQKISGPGIASKFSTNRYFYCKEDFDFLWVRTTDISAIKSIGQSTSFCWEIGEGLEASDTFRNFPYYQEDMNRLDLEDGEEFCSASETVPLIRCGSDKLAYEVLFQLNSLVHTQKISLAAVDSDLIKILRNLTVNTAIIILQKLHKLKMTCYDPLSFVKQSLRESLSSPPKSLTENNIMSCHRALITPSKIFCLGPEYETSNYVVKHFAQYASDFIRVTFVEEDWSKLPANAISTSIQRGIFAKPFRTGIYHRILSILRDGFVIGAKRFEFLAFSASQLRSNSVWMFASNNGVKAEDIRKWMGCFDKIRSVSKCAARMGQLFSSSLQTFVVPVQDVEIIPDIEVTTDGIDYCFSDGIGKISLSFAKQVAHKCGLSHTPSAFQIRYGGYKGVVAVDRNSFRKLSLRSSMLKFDSENRMLNVTKWSESMPCYLNREIISLLSTLGVADEIFQALQQKQLYRLRKMLTNKESALDVLENLAWADSKNILVQMLLQGYEPNVEPYLSMMLQAYHENSLMELRSRCRIFVPKGRILIGCLDESGILDYGQVYVRITMTKAELQCCDQSFFRKVDESTSTIIGEVAVTKNPCLHPGDIRVLEAVYDVELEEKGLVDCIIFPQNGGRPHPNECSGGDLDGDQFFISWDEGLLPCHTEAPMDYVGGRQRIMDHNVTLEEIQRFFVDYMINDTLGAISTAHLVHADCEPDKARSEKCLQLATLHSMAVDFAKTGAPAEMPLYLKPREFPDFMERAEKQMYISDGVLGKLYRDIHDSTRQERSNFMWSKKIAEATYDQDLEVKGFEDFLGIASIYKEKYMEKMSTLMDYYGAKTEDEILTGNLRHRPTYLQRDNRKYGDVKDRILVSLKNLKKEAKEWFESSCNPTEHQCMASAWYHVTYHPTYFHERMNCLSFPWIVGDILLNIKSLNSRNA

SEQ ID NO: 144 - protein, 1129 aa, B. Napus
MVSEITRSTVKLTNVPQTIIAEELLRFLELHLGADSVFALEIPTSRDNWKPRDFALVQFTSLEAKSRAQHLSSQSKLLFKSRNLRVSEAYDDIVPRPVDPRRRLDGVVLTAGFPESEEGRFCALEKWEGVRCWVIEEKRRVEFWVWESGDCYKCEVRFEDIAETVPSCVDGVDEINAFLLRLKYGPKIYKQVSGPHIATKFKSGRYSFCKEDFDFMWIRSTDFSGLKSIGTSTCFCLEVDNASTMSDIFSSLPYYREDTLSLTLVDGYTFASANQIVPLLNAANLGIEIPYEILFQLNSLVHAQKISLFAASNMGLISILCGLSLETALVILKKLHQQSSICYDPISFVKAQSQYVVKKTAHSPASAYKRLTEQNIMSCQRAYVTPSKIYLLGPELETANYVVKNFAEHASDFMRITFVEEDWSKIPANALSVNSKEGYFVKPFRTNIYHRVLSILGEGITVGPKKFEFLAFSASQLRGNSVWMFASNEKVKAEDIREWMGCFRKIRSISKCAARMGQLFSASRQTLNVRAQDVEQIPDIEVTTDGADYCFSDGIGKISLAFAKQVAQKCGLSHIPSAFQIRYGGYKGVIAVDRSSFRKLSLRDSMLKFDSNNRMLNVTRWTESMPCFLNREIICLLSTLGIEDAVFEAMQAGHLSILGNMLEDRHAALNVLQKLSGESSKNLLVKMLLQGYAPSSEPYLSMMLRVHHESQLSELKSRCRILVPKGRILIGCMDEMGILEYGQVYVRVTLTKAELESREQSHFRKIDEETSVVVGKVVVTKNPCLHPGDIRVLDAIYEVNFEQKGFLDCIVFPQKGERPHPNECSGGDLDGDQFFVSWDEKLIPSQMDPPMDYAGSRPRIMDHDVTLEEIHKFFVDYMISDTLGVISTAHLVHADRDPERARSQRCIELANLHSRAVDFAKTGAPAEMPYALKPREFPDFLERFEKPMYISGSVFGKLYRAVKSTLAQRKPEDAESEDKKKMAAYDSTLEEAGFDNFIETAKAHRDMYAEKLSSLMNYYGAANEEEILTGILRTKEMYLQRDNRRYGDMKDRITLSVKDLQREAMGWFEKSCEDEQQRKKLASAWYYVTYNPSYCDEKPRFLSFPWIVGDVLLGIKAESAEGEREMMIA

SEQ ID NO: 145 - protein, 1172 aa, Arabidopsis thaliana
MPDMDIDVKDLEEFEATTGEINLSELGEGFLQSFCKKAATSFFDKYGLISHQLNSYNYFIEHGLQNVFQSFGEMLVEPSFDVVKKKDNDWRYATVKFGEVTVEKPTFFSDDKELEFLPWHARLQNMTYSARIKVNVQVEVFKNTVVKSDKFKTGQDNYVEKKILDVKKQDILIGSIPVMVKSILCKTSEKGKENCKKGDCAFDQGGYFVIKGAEKVFIAQEQMCTKRLWISNSPWTVSFRSENKRNRFIVRLSENEKAEDYKRREKVLTVYFLSTEIPVWLLFFALGVSSDKEAMDLIAFDGDDASITNSLIASIHVADAVCEAFRCGNNALTYVEQQIKSTKFPPAESVDECLHLYLFPGLQSLKKKARFLGYMVKCLLNSYAGKRKCENRDSFRNKRIELAGELLEREIRVHLAHARRKMTRAMQKHLSGDGDLKPIEHYLDASVITNGLSRAFSTGAWSHPFRKMERVSGVVANLGRANPLQTLIDLRRTRQQVLYTGKVGDARYPHPSHWGRVCFLSTPDGENCGLVKNMSLLGLVSTQSLESVVEKLFACGMEELMDDTCTPLFGKHKVLLNGDWVGLCADSESFVAELKSRRRQSELPREMEIKRDKDDNEVRIFTDAGRLLRPLLVVENLQKLKQEKPSQYPFDHLLDHGILELIGIEEEEDCNTAWGIKQLLKEPKIYTHCELDLSFLLGVSCAVVPFANHDHGRRVLYQSQKHCQQAIGFSSTNPNIRCDTLSQQLFYPQKPLFKTLASECLKKEVLFNGQNAIVAVNVHLGYNQEDSIVMNKASLERGMFRSEQIRSYKAEVDAKDSEKRKKMDELVQFGKTHSKIGKVDSLEDDGFPFIGANMSTGDIVIGRCTESGADHSIKLKHTERGIVQKVVLSSNDEGKNFAAVSLRQVRSPCLGDKFSSMHGQKGVLGYLEEQQNFPFTIQGIVPDIVINPHAFPSRQTPGQLLEAALSKGIACPIQKEGSSAAYTKLTRHATPFSTPGVTEITEQLHRAGFSRWGNERVYNGRSGEMMRSMIFMGPTFYQRLVHMSEDKVKFRNTGPVHPLTRQPVADRKRFGGIKFGEMERDCLIAHGASANLHERLFTLSDSSQMHICRKCKTYANVIERTPSSGRKIRGPYCRVCVSSDHVVRVYVPYGAKLLCQELFSMGITLNFDTKLC

SEQ ID NO: 146 - protein, 1169 aa, A. lyrata
MDINEMDIDEIEIAGQMNLSELGETFLQSFCKKAATSFFEEFGLISHQLNSYNFFIEHGLRNVFESFGEMLVEPSFDVIKKKDGDWRYATVKFGEVTFEKPTFFSDDKELEFLPWHARLQNMTYSARIKVNVQVEVFKKTVVKSDKFKTGQDEYVEKEILDVKKQDILIGSIPVMVKSVLCKTSEKGKENCKKGDCAFDQGGYFVIKGAEKVFIAQEQMCTKRLWISNSPWTVSFRSETKRNRFIVRLSENEKADDYKRREKVLTVYFLSTEIPVWLLFFALGVSSDKEAMDLIAFDGVDASITNSLIASIHEADAVCEAFRCGNNALTYVEHQIKSTKFPPAESVDDCLRLYLFPGLQGLKKKARFLGYMVKCLLSAYAGKRKCENRDSFRNKRIELAGELLEREIRVHLAHARRKMTRAMQKQLSGEGELKPIEHYLDASVITNGLNRAFSTGAWSHPFRKMERVSGVVANLGRANPLQSLIDLRRTRQQVLYTGKVGDARYPHPSHWGRVCFLSTPDGENCGLVKNMSLLGLVSTQVLESVVEMLYACGMEELMDDTSTPLCGKHKVLLNGDWVGLCADSESFVAELKSRRRQSELPREMEIKRDKDDNEVRIFTDAGRLLRPLLVVENLHKLKQDKPTQYPFKHLLDQGILELIGIEEEEDCNTAWGIKQLLKEPKNYTHCELDLSFLLGVSCAIVPFANHDHGKRVLYQSQKHCQQAIGFSSTNPNIRCDTLSQQLFYPQKPLFKTVASECLKKEVLFNGQNAIVAVNVHLGYNQEDSIVMNKASLERGMFRSEQIRSYKAEVDTKDSEKRKKMDELVKFGKTYSKIGKVDSLEDDGFPFIGANMSTGDIVIGRCTDSGADHSIKLKHTERGIVQKVVLSSNDEGKNFAAVSLRQVRSPCLGDKFSSMHGQKGVLGYLEEQQNFPFTIQGIVPDIVINPHAFPSRQTPGQLLEAALSKGIASPIQKKEGSSAAYTKLTRHATPFSTPGVTEITEQLHRAGFSRWGNERVYNGRSGEMMRSLIFMGPTFYQRLVHMSEDKVKFRNTGPVHPLTRQPVADKKRFGGIKFGEMERDCLIAHGASANLHERLFTLSDSSQMHICRKCKTYANVIERTPSSGRKIRGPYCRVCASSDHVVRVYVPYGAKLLCQELFSMGITLNFDTKLC

SEQ ID NO: 147 - protein, 1197 aa, C. Sativus
MGTSGAKDDIEMNSEGEDLSPGMDLDTDDDDDYYSEPVNIHDLGEAFLKDFCKKSSMAFFNQYGLISHQINSYNDFIKNGIQKAFDFFGDILVQPGYDPSKKGDGEWRYATVKFGKVTLDKPKFWGGAASGKEYNMLPRHARLQNMTYSSRMKINISLEIYTQKLVSSDKFKTGKDQYVDKEPVEGASDNRDVFIGRLPVMVNSDLCWMKDGQKRDCEFDRGGYFLIKGAEKIFIAQEQICLRRLWISNVQGWTVAYRSEVKRNRLIIRLVENSKSEDLKSKEKVLNVYFLSTEVPVWILFFALGVSSDKEIVDLIDYGRDDPTVLNILFASVREVDNDDKWKDFRRGKRALTFLDNEIRKTSFPPADKIEDCLNLYLFASLKGSKQKCHFLGYMVKCLLQAYTGRRKCDNRDDFRNKRFELAAELLERELKVHIAHARRRMEKALQRDLYGDRQVHPIEHYLDASIITNGLSRAFSTGAWAHAFKRMERISGVVATLGRANPLQTMAELRRTRQQVAYTGKVGDARYPHPSHWGRVCFLSTPDGENCGLIKNLSGTGLVSLNTKKSITPTLFRCGMENLVDNTSTSFCGKYRIFLDGEWVGVCEDSLSFVTNVRRKRRRNPFLHQVEVKRDEQLKEVRIFSDAGRILRPLLVVENLNRIDKSKGENYTFQSLLDKGIIELIGTEEEEDCRVAWSIKHLMEDEGTTKYSHCELDMSFLLGLSCGLVPFANHDHARRALFQSQKHSNQAIGFSPTNSNFRVDTLSHQLHYPQRPLFRTMTADCLGTPGYLSSHAGILPKPEFYNGQNAIVAVNVHLGYNQEDSLVMNRASLERGMFRSEHIRSYKAEVDNKESSEKRRKSDDAINFGKTQSKIGRVDSLDDDGFPYIGANLQSGDIVIGRCAESGADHSIKLKHTEKGMVQKVVLSSNDDGKNYAVVSLRQVRSPCLGDKFSSMHGQKGVLGFLESQENFPFTIQGIVPDIVINPHAFPSRQTPGQLLEAALGKGIAAGGSLKYATPFSTPSVDAITDQLHRAGFSRWGSERVYNGRTGEMMRSLIFMGPTFYQRLIHMAEDKVKFRNTGPVHPLTRQPVADRKRFGGIKFGEMERDCLIAHGASANLHERLFTLSDSSQMHVCQKCKNVASVIQRSVAGGRKMRGPYCRVCESFDDIVRVNVPYGAKLLCQELFSMGINLKFETQLC

SEQ ID NO: 148 - protein, 1220 aa, V. vinifera
MKRSGALKCLVFIVHSHKSIFCSLHAECVNLNISTLMGASDAKGDLGMSSSMGEKLSNGVQMEIDDDLMGSIEIDDLNKEYLKTFCKKVAVSFFNEYGLIQHQINSFNDFIKNGIQRVFDSFGEIPVEPGYDPSKRGEGDWRYASVRFGKVTLERPRVWAGESDGKESLNFLPRHARLQNMTYSSRMKAQVHFQVYTQKLVRSDKYKTGKDNKYVEKKVIFEDNRDILIGRIPVMVKSELCWMNGVERGDCEYDHGGYFLIKGAEKTFIAQEQICLKRLWVSSNPTWMVAYRPIWKRKRVYVKLEPPKDENNRGGEKVLTVYFSSTEIPIWILFFALGASSDKEVVDLIDFNIDDAGISNILVASIHEADREAEKKGMYFRRQGNAISFVDKLVKSCKFPPGESIQECISKYLFPNFSGVKQKARFLGYMVKCLLQAYTGRRKCDNRDDFRNKRLELAGELLERELRVHIRHAERRMVKAMQRELYGDRDLRPIENYLDASIITNGLSRAFSTGQWSHPFKRMERISGVVATLRRTNPLQMTADMRKTRQQVQYTGKVGDARYPHPSHWGKVCFLSTPDGENCGLVKNLAITGLVSTEVLDPLVDKLFDCGMEKLVDDTSTKLSGKNKVFLDGDWVGVCEDPISFVVELRTKRRHKELPQQVEIKRDEQQGEVRIFSDAGRILRPLLVVENLKKVKTFKGDDFTFQSLLDKGIVELIGAEEEEDCSTAWGIKYLLKGHDDPPVKYTHCELDMSFLLGLSCGIIPYANHDHARRVLYQSEKHSQQAIGFSTTNPNIRVDTLSHQLYYPQRPLFRTMISDLPRPEYFNGQIAIVAVNVHLGYNQEDSLVMNRASLERGMFRSEHIRSYKSEVDNNESLDKKRKSEDSVHFGKMQSKIGRVDSLDDDGFPFIGANLQNGDIVIGRCAESGVDHSIKLKHTERGMVQKVVVSANDDGKNFAVVSLRQVRTPCLGDKFSSMHGQKGVLGFLESQENFPFTIQGIVPDIVINPHAFPSRQTPGQLLEAALGKGIACGGLLRHATPFSTLSVDAIADQLHRAGFSRWGHERVYNGRTGEMLRSLIFMGPTFYQRLIHMAEDKVKFRNTGPVHPLTRQPVSDRKRFGGIKFGEMERDCLIAHGAAANLHERLFTLSDSAYMHICRRCKNISNVIQRSVAGGRKVRGPYCRYCESSEEIVKVNVPYGAKLLCQELFSMGISLKFETQLC

SEQ ID NO: 149 - protein, 1188 aa, M. truncatula
MEHIGSSKDANNTNYTEMDIDLDDDEDQSNAEILNELGDDMVKYFCKKASVMFFDQYGLISHQINSYNQFINSGLQSAFDSFGDLTVTPGFDPSKKGADEHYRYATVKFGKVTLERPKFWCGEGNAQELKMLPRHARLQRMTYASKMKVDVHIQVYVMKKVRSDKFKTGKEEYIDKDIKWEDTREITIGRLPVMVKSDLCWMSEAEKGDCEFDHGGYFLIKGAEKIFIAQEQIFLKRLWVSNIPYWAVAFKSQMKRNRMVVKLVEGSTEGITNGEKLLTVYFLSVEIPVWILFFALGVTSDKEIVDLIDYGEANGRIENILFASIREADDKCEAFRRGKNALLFLEERVKGVQFPPAESIDECFNMYVFPNVKGLKRKARYLAYMVKVLLLAYTGRRKTDNRDDFRNKRLELAGELLEREIKVHFAHARKRMGKALQRDLYGEREVRQIEHYLDASIITNGLQRAFSTGAWTHPFKRMERISGVVATLGRTNPLQTMAELRRTRQQVQYTGKVGDARYPHPSHWGKVCFLSTPDGENCGLVKNLAVTGVVSTDVTESILPQLSDCGMEELVDDTTTVLGKKDKVFLNGDWVGVCSDSISFVAELRTRRRRNELPHQVEIKRDQCQQEVRILSDAGRILRPLLVVSNLLKIKGSKSEHKSFQSLLDNGVIELIGPEEEEDFKTAWGVQYLFGKEGKSSVKYTHCELDMSFLLGLSCSLVPFANHDHARRVLYQSQKHSSQAIGFATTNPNIRVDALSHQLFYPQRPLFQTMTSDCLGKPGYLGQSKVVPKSEFYNGQNAIVAVNVHLGYNQEDSLVMNRASLQRGMFRSEHIRSYKAEIENKESSEKRKKPEDIVNFGKIQSKIGRVDSLDDDGFPFVGANLQSGDIIIGRCADSGTDHSIKLKHTERGYVQKVVLSSNDEGKNFAVVSLRQVRSPVLGDKFSSMHGQKGVLGFLESQENFPFTKQGIVPDIVINPHAFPSRQTPGQLLEAALGKGIACVGSLRNATPFSTSSVEAITDQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKNVANVILRPVSGGRKIRGPYCRFCESADDIVVASVPYGAKLLSQELFSMGINLKFETELC

SEQ ID NO: 150 - protein, 1203 aa, R. Communis
MVEYDDAMEQDNDIGTSSKTEKLFKASTDMDIDFDSDSGSDCDFMDSSTSLTDIGEAKLKDFCNKAATLFFNEYGLISHQINSYNDFINNGIQKAFDSFGELVVEPGYDPSKKGENEWRYASVKFGKVALEKPTFWSGADEHKMLPRHARLQNMTYSSKMKVNVSVEVYTRKVVRSDKFKTGKDQYVDKEVLNTDNRNITIGSLPVMVKSDLCWMKTAEKGDCDFDHGGYFLIKGAEKVFIAQEQICLKRLWISNIQGWTVSYKSEIKRNRLIVRLVGLSALEDVKAEKKCLTVYFLSTEIPLWILFFALGVTSDKEVIDLIGYGSNDARIVNIFFASIHDADEKTEGFRRGKEALEYVVRQIRGTRFPPGENEDFFLLYLFPTLHSLRQKARFLGYMVKCLLQAYNGQRKCNNWDSFRNKRFELAKELLERELKVHIAHARRRMAKALQKDLYGDRDVRPIEHYLDASIVTNGLSRAFSTGAWSHPYKRMERISGVVANLGRANPLQTMVDLRKTRYHVQYTGKVGDARFPHPSHWGRVCFLSTPDGENCGLVKNLATTGLVSVNILEPLIDKLIARGMEKVPEDSHSDLDEKDKVFLNGEWVGVCEDSRLFVAELRRLRRRKKLPQQVEIKRDEQQQEVRIFSDAGRILRPLLVVQNLHKIEAFKGGNCTFQSLLDKGIIEFVGTEEEEDCSTAWGIKFLLSGVDGKQSLKYTHCELDMSFLLGLSCGIIPFANHDHARRVLYQAQKHSQQAIGFPTTNPNIRVDTLSHQLYYPQRPLFRTVTSDCLGKPGDTRGHNGIVPKPELYNGQNAIVAVNVHLGYNQEDSLVMNRASLERGMFRSEHIRSYKADVDNKELLDKRRKYDDNVNFGKIPSKIGRVDSLDDDGFPFIGANLQSGDIVIGRCAESGPDHSIKLKHTERGMVQKVVLSSNDEGKNFAVVSLRQVRSPCLGDKFSSMHGQKGVLGFLESQENFPFTRQGIVPDIVINPHSFPSRQTPGQLLEAALGKGIACGGSMKYATPFSTLSVEAITNQLHRAGFSRWGNERVYNGRTGEMVRSLIFMGPTFYQRLIHMAEDKVKFRNTGPVHPLTRQPVADRKRFGGIKFGEMERDCLIAHGASANLHERLFTLSDSSQMHICQKCKNVANVIQRAVPGGRKIRGPYCRVCESVDEIVKVNVPYGAKLLCQELFSMGISLKFETRLC

SEQ ID NO: 151 - protein, 1205 aa, G. max
MGHVGSSKDGTKVGLSAAAMDIDDDDDDDDDDLGDVDLDPTNSEILEELGEDMVKYWCKKASMLFFDEYGLISHQINSFNHFVAIGLQNTFDSFGDLVVTPGFDPSKKGENEHFRYASVKFGKVKLDKPMFWGGEGNAQEFKMLPRHARIQRMTYASKVKIQVKVQVYVPKKVRSDKFKTGKEEFLDREIMKEDEREIIIGRLPVMVKSDLCWMKDAEKDDDEFDHGGYFIVKGAEKTFIAQEQLYLKRLWVMNSPGWMIAYKSQMKRNRMVIKLVGNSRSEEVENGDMCLTVYFLSVEVPVWVLFFALGVSSDKEIVDLIGCGNDDVRIQNILFASVRDADEKCGAFRRVRNAVQYLEKCVKSVQFPPSESMQECLEMYVFPGISGLNRKARFLAYMVKGLLLAYTGRRKCDNRDDFRNKRLELASELLDRELKVHVAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLTTPDGENCGLVKNLSVTGLVSTDVTDVTESILLKLVDCGMQELVDDTSTHLGSMDKVLLNGDWVGVCPDSSSFVAELRSRRRRNELPHQVEIKRDQSQHEVRIYSDAGRILRPLLVVGNLLKIKGFKSDRYSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMTSDCLGKPDHSLGQSKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKCAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILKQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKKVANVILRPVSGGRKIRGPYCRHCESADDIVVAHVPYGAKLLCQELFSMGINLKFETQLC

SEQ ID NO: 152 - protein, 1229 aa, Z. mays
MEEPQKDSGQPSKSSDSELEAMVLDDNGAGKSHSMEENRDSPIDVDGGQSSMDVDIKGKSSLSDDVNGKSSSEPYSNAPIDMSVESLEKFCKEASRSFFDEVGLISHQINSYNEFVSHGLQELFDSLGEVIVEPGYDPSKKGSGGWKHAIIKFGRVKLEKPVFWTGKDEGSVDFKPWHARLQNMTYASRLIVEVTIQVYSLEKSDKSKTGNDGFVQKRNFMNETHWIFIGLLPVMVKSNLCLLHSLNESECLFDAGGYFLVKGMEKVFIAQEQRCLRRLWISDRPCWTISFMSEIKRRRIYIKLVESTRSEDFSESKIITISFLYATMPVWLLFFALGISSDKEVFDMIDMQDCDASVINTISATIKESDKLCEDFRKSDKARQYVDELVKSSRFPPAESFDDYIARFLFPDISGNRNKALFLGYMVKCLLMAFTGKRKCDNKDDFRNKRLDLPGELLGRELRAQLRLAEKRMVKAIQRDLNSDRELQDLERYIDASIVTNGLNRAFSTGSWCHPYKRAERCSGIVATLRRTNPLQMMSDLRKTRQRVAYAGKAGDARYPNPSYWGKLCFMSTPDGENCGLVKNLAVTAIVSSRVMQPLIESFISCGMSKLNDIPTEHIQRMDKIFLNGNWVGSCENSASFVFRLRCMRRSSLIDPQVEIKRDKHHNEVRVFTDAGRILRPLLVVENLNKIRKPKGRSFSFHELMQQEIIEFIGVEEEEDIQCAWGIRHLFESEGAISSYTHCELDPSFLLGLSCGIIPFANHNFARRVLYQSEKHSQQAIGYSTTNPHIRVDTLSHQLYYPQRPLFKTVIADCLGRSDYASFGRKNDFARPEYFNGQNAIVAVNVHQGFNQEDSLVMNRASLERGMFRTEHLRSYKADVENKDGTKRLKLKEKIDFGKTESKRGRVDNLDDDGLPYVGASLQTNDIVIGKVSESGEDHSIKLKHTEKGMVQKVLLSANDEGKNFAVVTLRQVRTPCLGDKFSSMHGQKGVVGFLESQENFPFTHEGIVPDIVINPHAFPTRQTPGQLLEAALGKGIACKGTMRYATPFTTASVDVIAEQLHRAGYSRWGSENVLNGRTGERVQSLVFMGPTFYQRLIHMSEDKVKFRNTGPVHPLTRQPVADRKRFGGVKFGEMERDCLLAHGSAANLHERLFLLSDFSQMHICQTCERVANVVMRSVPGGKKIRGPYCGFCKSSENIVRINVPYGAKLLYQELFSMGICLKFETQVC

SEQ ID NO: 153 - protein, 1228 aa, S. Bicolor
MEELQKDGGQQSNGSDSEPEAMVLDDNGAGKSHSMDGNRDSPVDVDEGQSSMDVDTKGKPSLNDDVNGKSSEPYSNAPIDLSVESLEKFCKEASRSFFDEVGLISHQINSYNDFVSHGLQELFDSLGEVIVEPGYDPSKKGSGGWKHAIIKFGRVKLEKPVFWTGKDEGSVDFKPWHARLQNMTYASRLIVEVNIQVYSLEKSDKSKTGNDGFVQKRDFMNETHWIFIGLLPVMVKSNLCLLHSLKESECLFDAGGYFLVKGMEKVFIAQELRCLKRLWIIDRPCWMISFMSEMKRRRIYIKLVESTRSEDFSGSKIISISFLYATMPVWLLFFALGISSDKEAFDVIDMQDCDASVINTISATIKESDELCEGFRKSDKARQYVDELVKSSRFPPAESFDDYIARFLFPDISGNRNKALFLGYMVKCLLMAFTGKRKCDNKDDFRNKRLDLPGELLGRELRAHLRLAEKRMVKAIQRDLNSDRELQDLERYIDASIVTNGLSRAFSTGSWCHPYKRAERCSGIVATLRRTNPLQMMSDLRKTRQRVAYAGKAGDARYPNPSYWGKLCFMSTPDGENCGLVKNLAVTAIVSSRVVQPLIESFISCGMSKLNDIPTEHIQRMDKIFLNGNWVGSCKDSASFVFRLRCMRRSSLIDPQVEIKRDKHHKEVRVFSDAGRILRPLLVVENLKKIRKPKGRSFSFQELMQQEIIEFIGVEEEEDIQCAWGIRHLFESEGAISSYTHCELDPSFLLGLSCGIIPFANHNFARRVLYQSEKHSQQAIGYSTTNPHIRVDTLSHQLYYPQRPLFKTVIADCLGRSDYTTFGRKDDFMRPEYFNGQNAIVAVNVHQGFNQEDSLVMNRASLERGMFRTEHLRSYKADVENKDGTKRLKLKEKIDFGKTESKRGRVDNLDDDGLPYIGASLQTNDIVIGKVSESGEDHSIKLKHTEKGMVQKVLLSANDEGKNFAVVTLRQVRTPCLGDKFSSMHGQKGVVGFLESQENFPFTHKGIVPDIVINPHAFPTRQTPGQLLEAALGKGIACKGTMRYATPFTTASVDVIAEQLHRAGYSRWGTENVLNGRTGERMQSLIFMGPTFYQRLIHMSEDKVKFRNTGPVHPLTRQPVADRKRFGGVKFGEMERDCLLAHGSAANLHERLFMLSDFSQMHICQTCERVANVVMRSVSGGKKIRGPYCGFCKSSENIVRINVPYGAKLLYQELFSMGICLKFDTEVC

SEQ ID NO: 154 - protein, 1270 aa, O. Sativa
GFALRRRPSSPPGYSLEVMEEPSKDNGQSSCVVDPELEPMMLDDAREGVSHTLDDANGHSSMDVDRGCHSMDTTRSSLGDDGKGKRDSYAQIPVDMSIPSLEKFCKEASRSFFDEIGLISHQINSYNEFVSHGLQELFDSLGEVTVEPSYDPSNRGPGGWRHAIIKFGRVQLEEPVFWSHGCDIDEQSLKLKPRHARLQNMTYSSKMKVEVHFQVYSMEKSDKAKTGNDKFGYKRNIINETYYINIGRLPVMVMSNLCWLHKLKESDCQFDSGGYFLIKGMEKVFIAQEQKCLTRIWVEDRPCWMVSFLSPIRRRRIYIKLIDSANNEDASGGKIISISFLYANMPIWLMFFALGISSDKDIFDVINMEDCDACVINTITATIKESDELCEGFRKSDKARQYVDELIKNSKFPPAEPFDDYIAKYLFPSISGNRNKALFLGYMVKCLLMAFTGKRKCDNKDDFRNKRLDLAGELLGRELRAHIRHAERLMVKALQRDLNSERELQEFDHYLDASIITNGLNRAFSTGSWCHPYKRNERCAGIVATLRRTNPLQMISDLRKTRQRVAYAGKAGDARYPNPSYWGKLCFMSTPDGENCGLVKNLAVTATVSSRVAPPLIDRFISCGMNKLHEIPTEEVPRMDKIFLNGDWVGSCSDPASFVLRLRCMRRSGLIDPQVEIKRDKHQREVRVFSDAGRILRPLLVVENLNKIRRPKGSSYSFQWLMQQEIIEFIGVEEEEDIRSAWGIRNLFESEEEAPMVKMNKAEDVFNVKRKIGGEVSGYTHCELDLSFLLGLSCGIIPFANHNFARRVLYQSEKHSQQAIGYSTTNPHIRVDTLSHQLYYPQRPLFKTVIADCIGRSEYTFGRKDDFARPEYFNGQNAIVAVNVHQGFNQEDSVVMNRASLERGMFRTEHFRNYKAEVENKGGPGGNKRLKMKDKIDFGKMQSKRGRVDNLDDDGLPYVGASLQSGDIVIGKVSESGEDHSIKLKHTEKGMVQRVLLSANDEGKNFAVVTLRQVRSPCLGDKFSSMHGQKGVVGFLESQENFPFTYQGIVPDIVINPHAFPTRQTPGQLLEAALGKGIALGGTMRYATPFTTASFDVITDQLHKAGFSRWGAESVLNGRTGERMHSLIFMGPTFYQRLIHMAEDKVKFRNTGPVHPLTRQPVADRKRFGGVKFGEMERDCLLAHGAAANLHERLFMLSDFSQMHVCQTCERVANVIMRPVPGGKKIRGPYCGFCRSSENIVRINVPYGAKLLYQELFSMGICLRFETEVC

SEQ ID NO: 155 - protein, 1192 aa, B. distachyon
MILDDNEESGSHTMDDSNGQSSMDIDIEGSSMGEQIPADMNLTSLEKFCKEASRSFFEEIGLISHQINSYNEFISHGLQELFDSLGEVTVEPGYDPSKKGPGGWRHAIIKFGKVKLEEPVFWSGKIDIDEESLKLKPRHARLQNMTYSSKMEVEVNIQVYSMEKSDKAKTGNDHFGHKRDIINETHWVTIGRLPVMVNSDLCWLHKLGESDCLFDSGGYFLIKGMEKIFIAQEQRCLTRIWVADQPCWNVSYLSEMKRRRVYIKLIDSTTNNDLNGAKIISISFLYANMPIWLLFFALGVSSDKEVFDMIDMKDCDASVINAIYATIRESDELCEGFRQSDKARKYVDDLVKSSKFPPAEPFTDYVAKYLFPGISGNRNKSFFLGYMVKCLLMAFTGKRKCDNKDDFRNKRLELPGQLLGRELRAHLRHAERLMVKAMQRDLNSDRDLQFPLRYLDASIITNGINRAFATGSWSHPYIRNERCSGIVATLRRTNPLQMMSDLRKSRQQVAYAGKVGDARYPNPSYWGKMCFMSTPDGENCGLVKNLAVTAIVSSRVVQPLIDRFVSCGMNKLDEISAKEIPKMDKIFLNGDWIGSCTDPASFVMRLRCMRRANLIDPQVEIKRDKHQFPGEVRVFSDAGRILRPLLVVENLNKIRKSKDRPYTFQALLQQEIIEYIGVEEEEDIQCAWGIRHLFPSSGEKVSGYTHCELDLSFLLGLSCGLIPFANHNFARRVLYQSEKHSQQAIGYSTTNPLTRVDTHSHQLYYPQRPLFKTVTADCIGRSDYTIGRKDDFARPEYFNGQNAIVAVNVHQGFNQEDSLVMNRASLERGMFRTEHIRSYKAEVETKEPTKRLKLKEKVDFGKMQSKRGRVDNLDDDGLPYVGASLQSGDIVIGKVSESGEDHSIKMKHTEKGMAQRVLLSANDEGKNFAVVTLRQVRSPCVGDKFSSMHGQKGVIGFLESQENFPFTCQGIVPDVVINPHAFPTRQTPGQLLEAALGKGIALGGAMRYATPFTPASLEVISEQLHKAGFSRSGAESVINGRTGERMHSLIFMGPNFYQRLTHMAEDKVKFRNTGPVHPLTRQPVADRKRFGGVKFGEMERDCLLAHGAAANLHERLFMLSDFSQMHICRTCERVANVVMRSVPGGKRIRGPYCGFCRSSENTVRIAVPYGAKLLYQELFCMGICLKFQTEIC

SEQ ID NO: 156 - protein, 1181 aa, P. trichocarpa
MGASSDYMEDVGPSSKGEVDDMDMDMDEDLMDTTNLNELGKETLQSFCKKAASLFFDEYGLISHQINSYNAFINSGLQRVFDSFGEVAVEPGYDSSKQKDGEWRRASVRFGKVTLDRPSFWGGTSSDAEHNMFPRHARLQNMTYSARMKIHVNVQVYTQTVGRSDKFKTGIDKVVQKNVVHTENREIIIGRIPVMVKSDLCWLTTVEKGDCDFDHGGYFLIKGAEKVFIAQEQICMKRLWISNSQGWTVSYKSEVKRNRLIVRLVELSKLEYIKGEKKGLCVYFLSTEIPLWILFFALGVRSDKEVIDLIDYASNDASIVNIFFASIHDADEKCEHFRREDRALDYVDKLLKKTRFPPKESIEDAISAYLFPRLNSRRHKARFLGYMVKCLLEAYTGHRKCDNRDSFRNKRFELASELLERELKVHVSHALRRMTKALQRDLYGDRDVHPIEHYLDASIVTNGLTRAFSTGAWCHPFKWMERVSGVVGNLGRANPLQTMIDLRKTRQQVLYTGKVGDARYPHPSHWGRVCFLSTPDGENCGLVKNLAVTGVVSTNISESLVDKLFDSGMEKLVDDTYTKLDGKHKVFLNGEWVGVCEDSCLFVGELRSMRRRRELPYQVEIKRDEQQREVRIFSDAGRILRPLLVVENLDKIKAFKGGNYIFTSLLDKGIIEFIGTEEEEDCCTAWGIKFLLADIEGKQPMKYSHCELDMSFLLGLSCGIIPFANHDHARRVLYQAQKHSQQAIGFSTTNPNIRVDTLSHQLHYPQRPLFRTMISDCLVLPKPELFNGQNAIVAVNVHLGYNQEDSLVMNRASLERGMFRSEHIRSYKAEVDNKELTDKRRKSEDSITFGKIQSKIGRVDSLDDDGFPFIGANMQSGDIVIGKCAESGADHSVKLKHTERGMVQKVVLSSNDEGKNFAVVSLRQVRSPCLGDKFSSMHGQKGVLGFLESQENFPFTIQGVVPDIVINPHAFPSRQTPGQLLEAALGKGIACGGSKRYATPFSTLSVDDIIDQLHRAKFSRWGNERVYNGRTGEMVRSLIFMGPTFYQRLVHMAEDKVKFRNTGPVHPLTRQPVADRKRFGGIKFGEMERDCLIAHGASANLHERLFTLSDSSEMHICQKCKNVANVIQRGVPGGRKIRGPYCRVCESVDDLVKVSVPYGAKLLCQELFSMGISLKFDTRVS

SEQ ID NO: 157 - protein, 1169 aa, B. Napus
MTDIDIEEIEAAGEIDLRDLGEPFLQSFCKKAATSFFDEYGLVSHQLNSYNFFIDHGLQSVFESSGEMLVEPSFDPTKNKDHEWRYATVKFGEVSVDKPTLYSDDKELVFLPWHARLQNMTYSARMKVNVDVEVFVKKVVKRDKFKTGQDEYVEKQILSKKTQDIPIGRIPVMVKSVLCNTTERGKHVESYRKGECAFDQGGYFVIKGAEKVFIAQEQICTKRLWISNSPWTVSYRSETKRNRFIVRLSENQKAEDFKRKEKVLTVYFLSTEIPVWVLFFALGVASDKEAVDLIAFDGGDASITNSVVAAIQEADSVCEDFRHGRNALAYVEQQIKGTKFPPGESVDECLSLYLFPGLKSLKQKARFLGYMVKCLFSAYAGKRKCENRDNFRNKRIELAGELLERELRVHLAHARRTMTKAMQRHLTGDGDLKPIEHYLDASIITNGLSRAFSTGAWCHPFRKMERVSGVVANLGRANPLQSLIDLRRTRQQVLYTGRVGDARYPHPSHWGRVCFLSTPDGENCGLVKNLSLLGLVSTQIMEPVVEKLFDSGMEELVDDTSTPLSGKHKVLLNGDWVGVCSDSDYFVAELKSRRRQSELPRQMEIKLDKDDKEVRIFTDAGRLLRPLMVVENLHKLKQSKPSKYTFEHLLDQGILELIGIEEEEDCTTAWGTKQLLKQQKSYTHCELDLSFLLGVSCAIVPFANHDHGRRVLYQSQKHCQQAIGFSSTNPNIRCDTLSQQLFYPQKPLFKTMASECLQKDVLFNGQNAIVAVNVHLGFNQEDSIVMNKASLERGMFRSEQIRSYKADVDSKDSEKRKKMDEVVQFGKTHSKIGRVDSLDDDGFPFVGANMHSGDIVIGRCTESGTDHSVKLKHTERGIVQKVVLSSNDDGKNYATVSLRQVRSPCLGDKFSSMHGQKGVLGYIEEQENFAFTNQGIVPDIVINPHAFPSRQTPGQLLEAALSKGIACPMQKKKGKSDAYSKVTRHATPFSTPSVDDITDQLHRAGFSRSGNERVYNGRTGEMMRSLIFMGPNFYQRLIHMSEDKVKFRNTGPVHPLTRQPVADRKRFGGIKFGEMERDCLIAHGASANLHERLFTLSDSSQMHICRNCKSAANVIERVASSGRRIRGPYCRLCESPDYVVMVNVPYGAKLLYQELFSMGICLNFETNLC

SEQ ID NO: 158 - protein, 319 aa, A. thaliana
MDGATYQRFPKIKIRELKDDYAKFELRETDVSMANALRRVMISEVPTVAIDLVEIEVNSSVLNDEFIAHRLGLIPLTSERAMSMRFSRDCDACDGDGQCEFCSVEFRLSSKCVTDQTLDVTSRDLYSADPTVTPVDFTIDSSVSDSSEHKGIIIVKLRRGQELKLRAIARKGIGKDHAKWSPAATVTFMYEPDIIINEDMMDTLSDEEKIDLIESSPTKVFGMDPVTRQVVVVDPEAYTYDEEVIKKAEAMGKPGLIEISPKDDSFIFTVESTGAVKASQLVLNAIDLLKQKLDAVRLSDDTVEADDQFGELGAHMRGG

SEQ ID NO: 159 - protein, 319 aa, A. lyrata
MDGATYQRFPKITIRELKDDYAKFELRETDVSMANALRRVMISEVPTVAIDLVEIEVNSSVLNDEFIAHRLGLIPLTSERAMSMRFSRDCDACDGDGQCEFCSVEFRLSAKCVTDQTLDVTSRDLYSADPTVTPVDFTIDSSASDSSEQKGIIIVKLRRGQELKLRAIARKGIGKDHAKWSPAATVTFMYEPDIIINEDMMDTLSDEEKIDLIESSPTKVFGIDPVTRQVVVVDPEAYTYDEEVIKKAEAMGKPGLIEIHPKDDSFIFTVESTGAVKASQLVLNAIDILKQKLDAVRLSDDTVEADDQFGELGAHMRGG

SEQ ID NO: 160 - protein, 320 aa, C. Sativus
MEGSSYQRFPKVKIRELRDDYAKFELRDTDASMANALRRVMIAEVPTIAIDLVEIEVNSSVLNDEFIAHRLGLIPLTSERAMSMRFSRDCDACDGDGQCEFCSVEFHLRAKCHSDQTLDVTSKDLYSSDHTVVPVDFSDSAAATGEALDTKGIIIVKLRRGQELRLRAIARKGIGKDHAKWSPAATVTFMYEPSIHINEDLMETLTLEEKRTWVESCPTRVFELDTVTHQVMVVDPEAYTYDDEVIKKAEAMGKAGLVDITAREDSFIFTVESTGAIKASQLILNAIDILKQKLDAVRLSDDTVEADDQFGELGAHMRGG

SEQ ID NO: 161 - protein, 318 aa, V. Vinifera
MEGVSYQRFPKIKIREVKDDYAKFELRETDASMANALRRVMIAEVPTVAIDLVEIEVNSSVLNDEFIAHRLGLIPLTSERAMSMRFSRDCDACDGDGQCEFCSVEFHLRAKCMTDETLDVTSKDLISSDHTVVPVDFSDSSGYDSADKKGIIIVKLRRGQELRLRAIARKGIGKDHAKWSPAATVTFMYEPEIHINEDLMESLTLEEKTSWVESSPTKVFDIDASSQQVVVADAEAYTYDDEVLKKAEAMGKPGLVEIYAKEDSFIFTVESTGAIKASQLVLNAIDVLKQKLDAVRLSEDTVEADDQFGELGAHMRGG

SEQ ID NO: 162 - protein, 318 aa, M. Truncatula
MEGASYARMPRVKIRELKDDYMKFELRDTDASVANALRRVMISEVPTVAIDLVEIEVNSSVLNDEFIAHRLGLIPLTSERAMAMRFSRDCDACDGDGQCEYCSVEFHLRVKCITDQTLDVSSKDLISSDHTVTPVDVPGGDASIESDGRGIIIVKLRRGQELRLRAIARKGIGKDHAKWSPAATVTFMYEPDIHINEDLMESLTLEEKKEWVDSSPTRVFDIDPVTQQVMVVDPEAYSYDDEVIKKAEAMGKPGLIEITAKQDSFIFTVESTGAVKASQLLLNSIEILKQKLDAVRLSEDTVEADDQFGELGAHMRGG

SEQ ID NO: 163 - protein, 318 aa, R. Communis
MEGASYQRFPRIKIRELKDDYCKFELRDTDASMANALRRVMIAEVPTVAIDLVEIEVNSSVLNDEFIAHRLGLIPLTSERAMSMRFSRDCDACDGDGQCDYCSVEFHLRAKCITDQTLDVTSKDLYSSDHTVVPVDFSDSSGYDSSEQRGIIIVKLRRGQELRLRAIARKGIGKDHAKWSPAATVTFMYEPDIHINEDLMESLSLEEKQSWVESSPTKVFDIDPNTQQVVVVDPEAYTYDEEVIKKAESMGKPGLVNIQAKEDSFIFTVESTGAIKASQLVLNAIEILKQKLDAVRLSEDTVEADDQFGELGAHMRGG

SEQ ID NO: 164 - protein, 319 aa, G. max
MEGGVSYARMPRVKIRELKDDYAKFELRDTDASIANALRRVMIAEVPTVAIDLVEIEVNSSVLNDEFIAHRLGLIPLTSERAMSMRFSRDCDACDGDGQCEFCSVEFHLRVKCMTDQTLDVTSKDLYSSDPTVSPVDFSDPSATDSDNNRGIIIVKLRRGQELKLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAVKASQLVLNAIEILKQKLDAVRLSEDTVEADDQFGELGAHMRGG

SEQ ID NO: 165 - protein, 328 aa, Z. mays
MDRPSGTSYQRFPRVRIRELKDDYAKFELRDTDASMANALRRVMIAEVPTVAIDLVEIEVNSSVLNDEFIAHRLGLIPLTSAAAMQMRFSRDCDACDGDGSCEYCSVEFHLSVHATDSDQTLEVTSNDLRSMDPKVCPVDQARAYQHALGGTDPFGANASNENRGILIVKLRRGQELRLRAIARKGIGKDHAKWSPAATVTFMYEPDIRINEELMETLTVEERISLIESSPTKVFELDSANQVVVKNAEAYTYDDEVIKHAEAIGKPGLVEITAKEDSFVFTVETTGAITAYELIMNAITVLRQKLDAVRLQDDDGDLGELGAHLGGP

SEQ ID NO: 166 - protein, 328 aa, S. Bicolor
MDRPVGASYQRFPRVRIRDLKDDYAKFELRDTDASMANALRRVMIAEVPTVAIDLVEIEVNSSVLNDEFIAHRLGLIPLTSAAAMQMRFSRDCDACDGDGSCEYCSVEFHLAARATDSDQTLEVTSNDLRSMDPKVCPVDQARAYQQALGGTDPFGANTSNENRGILIVKLRRGQELRLRAIARKGIGKDHAKWSPAATVTFMYEPDIRINEELMETLTVEERRRLIESSPTKVFKLDSANQVVVDNAEAYTYDDEVIKHAEALGKPGLVEINAKEDSFIFTVETTGAITAYELIMNAITVLRQKLDAVRLQDDDGDLGELGAHLGGP

SEQ ID NO: 167 - protein, 330 aa, O. Sativa
MERAAGGVSYQRFPRVRIRELKDDYAKFELRDTDASMANALRRVMIAEVPTVAIDLVEIEVNSSVLNDEFIAHRLGLIPLTSAAAMAMRFSRDCDACDGDGSCEYCSVEFHLAARATDSDQTLEVTSNDLRSTDPKVCPVDQARAYQHALGGTEPFDTAAAADQRGILIVKLRRGQELRLRAIARKGIGKDHAKWSPAATVTFMYEPEIRINEELMETLTLEEKRNLVESSPTKVFNIDPNTQQVVVEDAEAYTYDDEVIKKADAMGKPGLIEINAKEDSFIFTVETTGAITAYELIMNAITVLRQKLDAVRLQDDDADLGELGAHLVGG

SEQ ID NO: 168 - protein, 330 aa, B. Distachyon
MDRSAAGVSYQRFPRVRIRELKDDYAKFELRDTDASMANALRRVMIAEVPTVAIDLVEIESNSSVLNDEFIAHRLGLIPLTSSGAMGMRFSRDCDACDGDGSCEHCSVEFHLAARATDANKTLEVTSNDLRSTDPKVCPVDQAMAYQQAIGTADPYDTSTASDHRGILIVKLRRGQELRLRAIARKGIAKDHAKWSPAATVTFMYEPDIRINEELMETLTLEEKTSWVESSPTKVFDIDPNTQQVVVVDREAYTYDDEVIKKAEAMGKPGLIEISAKEDSFVFTVETTGAITAYELIINAITVLRQKLDAVRLQEEDGDFTGLDAHLGVA

SEQ ID NO: 169 - protein, 323 aa, P. trichocarpa
MESVSYQRFPKIKIREMKDDYLKFELRETDASMANALRRVMIAEVPTIAIDLVEIEVNSSVLNDEFIAHRLGLIPLTSERAMGMRFSRDCDACDGDGQCEYCSVEFHLRAKCITDQTLDVTSKDLYSSDHAVIPVDFSDPSDANDPFDHTETQRGIIIVKLRRGQELRLRAIARKGIGKDHAKWSPAATVTFMYEPEIHINEDLMETLTLEEKLSWIESSPTKVFDIDKVTQQVVVVDPEAYTYDDEVIKKAEAMGKRGLIDIRAKEDSFIFTVESTGAVKASQLVLNAIEILKQKLDAVRLSDDTVEADDQFGELGVHMRGG

SEQ ID NO: 170 - protein, 318 aa, B. Napus
MDTGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFHLRAKCVTDQTLDVTSRDLYSADATVTPVDFGVDSSDSGEQRGIIIVKLRRGQELKLRAIARKGIGKDHAKWSPAATVTFMYEPDIIINEDMMDTLTDEEKIDLIESSPTKVFDFDSVTRQVVVVDPEAYTYDEEVIKKAEAMGKVGLIEIRPKDDSFIFTVESTGAVKASQLVLNAIDLLKQKLDAVRLSDDTVEADDQFGELGAHMRGG

SEQ ID NO: 171 - protein, 319 aa, A. thaliana
MDGVTYQRFPTVKIRELKDDYAKFELRETDVSMANALRRVMISEVPTMAIHLVKIEVNSSVLNDEFIAQRLSLIPLTSERAMSMRFCQDCEDCNGDEHCEFCSVEFPLSAKCVTDQTLDVTSRDLYSADPTVTPVDFTSNSSTSDSSEHKGIIIAKLRRGQELKLKALARKGIGKDHAKWSPAATVTYMYEPDIIINEEMMNTLTDEEKIDLIESSPTKVFGIDPVTGQVVVVDPEAYTYDEEVIKKAEAMGKPGLIEIHPKHDSFVFTVESTGALKASQLVLNAIDILKQKLDAIRLSDNTVEADDQFGELGAHMREG

SEQ ID NO: 172 - protein, 319 aa, A. lyrata
MDGTTYQRFPKINIRELKDDYAKFELRETDVSMANALRRVMISEVPTIAIDLVNIEVNSSVLNDEFIAQRLGLIPLTSERAMSMRFCQDCDACDGEGQCEFCSVEFPLSAKCVTDQTLDVTSRDLYSADPTVTPVDFTIDSSASDSSEQKGITIVKLRRGQELKLKAIARKGIGKDHAKWSPAATVTFMYEPDIIINEDLMDTLTDEEKIDLIESSPTKVFGIDPVTRQVVVVDPEAYTYDEEVIKKAEAMGKPGLIEIYPKHDSFVFTVESTGALKASQLVLNAIDILKQKLDAICLSDDTVEADDQFGELSAHMRGG

SEQ ID NO: 173 - protein, 320 aa, C. Sativus; identical to SEQ ID NO: 160

SEQ ID NO: 174 - protein, 318 aa, V. Vinifera; identical to SEQ ID NO: 161

SEQ ID NO: 175 - protein, 318 aa, M. Truncatula; identical to SEQ ID NO: 162

SEQ ID NO: 176 - protein, 318 aa, R. Communis; identical to SEQ ID NO: 163

SEQ ID NO: 177 - protein, 319 aa, G. max; identical to SEQ ID NO: 164

SEQ ID NO: 178 - protein, 328 aa, Z. mays; identical to SEQ ID NO: 165

SEQ ID NO: 179 - protein, 328 aa, S. Bicolor; identical to SEQ ID NO: 166

SEQ ID NO: 180 - protein, 320 aa, O. Sativa
MEASYQRFPTVRIRDLKDDFLKFELRDTDASIANALRRVIIAEVPTLAIDLVEIEANSSVLNDEFIAHRLGLIPLTSDKAMEMRYSRDCDECDGDGRCDYCSIEFTLSVKCTSEETLDVTSHDLQSSDSQVVPVDSIGHDPDIENFNQKKGILIVKLRKGQELKLRAIARKGIAKDHAKWSPAATVTFQYEPDIHINENLMETLSVEEKREWVDSSPTKVFEINPETQQVEVIDPEAYTYDDEVIKKAEAMGKPGLVEIYGKEDSFIFTVESTGAIKAAQMFLNAIEILRSKLDAVKLNFGSDEADEQFGDLGAHMRGGF

SEQ ID NO: 181 - protein, 330 aa, B. Distachyon; identical to SEQ ID NO: 168

SEQ ID NO: 182 - protein, 323 aa, P. trichocarpa; identical to SEQ ID NO: 169

SEQ ID NO: 183 - protein, 318 aa, B. Napus; identical to SEQ ID NO: 170

SEQ ID NO: 184 - protein, 146 aa, A. thaliana
MNAPERYERFVVPEGTKKVSYDRDTKIINAASFTVEREDHTIGNIVRMQLHRDENVLFAGYQLPHPLKYKIIVRDPKDWFRNLKVVYGCLETVNISWFKLLVLTIHTTSQSSPMQAYNQAINDLDKELDYLKNQFEAEVAKFSNQF

SEQ ID NO: 185 - protein, 116 aa, A. lyrata
MNAPDRYERFVVPEGTKKVSYDRDTKIINAASFTIEREDHTIGNIVRMQLHRDENVLFAGYQLPHPLKYKIIVRIHTTSQSSPMQAYNQAINDLDKELDYLKNQFEAEVAKFSNQF

SEQ ID NO: 186 - protein, 116 aa, C. Sativus
MNAPDRYERFVVPEGTKKVSYERDTKIINAASFTIEREEHTIGNILRMQLHRDENVLFAGYKLPHPLQYKIIVRIHTTSQSSPMQAYNQAINDLDKELDHLKNAFEAEFAKFSRDY

SEQ ID NO: 187 - protein, 129 aa, V. Vinifera
MNAPDRYERFVVPEGTKKYIVFSLLSQKLSLVSYERDTKIINAASFTVEREDHTIGNILRMQLHRDENVLFAGYKLPHPLQYKIIIRIHTTSQSSPMQAYNQAINDLDKELDYLKNAFEVELAKHSREY

SEQ ID NO: 188 - protein, 76 aa, M. Truncatula
MNAPDRYERFVVPEGTKKVSYERDTKIINAASFTIEREDHTIGNVLRMQLHKDPNVLFAGYKLPHPLQYKIISRVS

SEQ ID NO: 189 - protein, 156 aa, R. Communis
MNAPDRYERFVVPEGTKKVSYERDTKIINAASFTVEREDHTIGNILRMQLHRDENVLFAGYRLPHPLQYKIIVRIHTTSQSSPMQAYNQAINDLDKELDHLKSAFEECLRPKGTKKGSWYTSSWRVSWPSFQGIIKHAGVQGRHCGCQLTMLFDGS

SEQ ID NO: 190 - protein, 116 aa, G. max
MNAPDRYERFVVPEGTKKVSYERDTKIINAASFTIEREEHTIGNILRMQLHRDPNVLFAGYKLPHPLQYKIIVRIHTTSQSSPMQAYNQSINDLDRELDHLKSAFEAEMLKFSRDY

SEQ ID NO: 191 - protein, 112 aa, Z. mays
MNAPDRYERFVVPEGTKKVSYERDTKIVNAASFTVEREDHTVGNILRMQLHRDPNVLFAGYKLPHPLQYKIIVRIHTTSQSSPTQAYTQAINDLDKELEYLKQAFETPTDHH

SEQ ID NO: 192 - protein, 117 aa, S. Bicolor
MNAPDRYERFVVPEGTKKVSYERDTKIVNAASFTIEREDHTIGNIVRMQLHRDPNVLFAGYKLPHPLQYKIIVRIHTTSQSSPTQAYSQAVNDLDKELEYLKQAFEDEKNRFEMARL

SEQ ID NO: 193 - protein, 120 aa, O. Sativa
MNAPDRYERFVVPEGTKKVSYERDTKIVNAGSFTIEREDHTIGNILRMQLHRDPNVLFAGYKLPHPLQYKILVRVHTANQSTPTQAYTQAINDLDKELENLKQAFEDEKIRYEERPKQGY

SEQ ID NO: 194 - protein, 119 aa, B. Distachyon
MNAPDRYERFVVPEGTKKVSFEKDTKIMNAASFTIEREDHTIGNILRMQLHRDPNVLFAGYKLPHPLQYKIIVRIHTASQSSPTQAYNQAINDLDSELENLKQAFEDEKNRFEERKQPY

SEQ ID NO: 195 - protein, 116 aa, P. trichocarpa
MNAPDRYERFVVPEGTKKVSYERDTKIINAASFTVEREDHTIGNILRMQLHRDDNVLFAGYKLPHPLKYKIIVRIHTTSQSSPMQAYNQAINDLDKELDHLKNAFEAELANRPGQY

SEQ ID NO: 196 - protein, 159 aa, B. Napus
MNAPDRYERFVVPEGTKKVSYERDTKIINAASFTIEREDHTIGNIVRMQLHRDENVLFAGYQLPHPLKYKIIVRIHTTSQSSPMQAYNQAINDLDKELDFLKSQFELVENQMLLTLRLCASVLSGRGGQVLVSLLRSSEFSIGTLESHFPYSKHQPEDL

SEQ ID NO: 197 - protein, 71 aa, A. thaliana
MIIPVRCFTCGKVIGNKWDQYLDLLQLDYTEGDALDALQLVRYCCRRMLMTHVDLIEKLLNYNTLEKSDNS

SEQ ID NO: 198 - protein, 71 aa, C. Sativus
MIIPVRCFTCGKVIGNKWDTYLDLLQADYPEGEALDMLGLVRYCCRRMLMTHVDLIEKLLNYNTMDKSEII

SEQ ID NO: 199 - protein, 71 aa, V. Vinifera
MIIPVRCFTCGKVIGNKWDTYLDLLQADYTEGDALDALGLVRYCCRRMLMTHVDLIEKLLNYNTLEKSETS

SEQ ID NO: 200 - protein, 71 aa, M. truncatula
MIIPVRCFTCGKVIGNKWDSYLDFLQADYTEGDALDALGLVRYCCRRMLMTHVDLIEKLLNYNTMEKHEAN

SEQ ID NO: 201 - protein, 76 aa, R. Communis
MIIPVRCFTCGKVIGNKWDTYLDLLQADYSEGDALDALGLVRYCCRRMLMTHVDLIEKLLNYNKYPFAALERSEGS

SEQ ID NO: 202 - protein, 71 aa, G. max
MIIPVRCFTCGKVIGNKWDTYLDLLQSDYSEGDALDALGLVRYCCRRMLMTHVDLIEKLLNYNTLDKSDPS

SEQ ID NO: 203 - protein, 71 aa, Z. mays
MIIPVRCFTCGKVIGNKWDLYLDLLQADYSEGDALDALELFRYCCRRMLMTHVDLIEKLLNYNTLEKTETS

SEQ ID NO: 204 - protein, 73 aa, S. Bicolor
MIIPVRCFTCGKVIGDKWDAYLELVQADYDEEDALTALNLNRYCCRRMLMTHVDLIEKLLNYNTLEKTTGTDS

SEQ ID NO: 205 - protein, 72 aa, O. Sativa
MIIPVRCFTCGKVIGNKWDLYLDLLQADYTEGDALDALGLVRYCCRRMLMTHVDLIEKLLNYNTLEKTETAG

SEQ ID NO: 206 - protein, 71 aa, B. Distachyon
MIIPVRCFTCGKVIGNKWDHYLDLLQADYTEGDALDALGLVRYCCRRMLMTHVDLIEKLLNYNTLEKTEAT

SEQ ID NO: 207 - protein, 74 aa, P. trichocarpa
MIIPVRCFTCGNCGKVIGNKWDTYLDLLQADYTEGDALDALGLVRYCCRRMLMTHVDLIEKLLNYNTLEKSEGS

SEQ ID NO: 208 - protein, 103 aa, B. Napus
MIIPVRCFTCGKVIGNKWDTYLDLLQADYTEGESLYDGFSGCYWCFDSVVCISSLIFIPLCVKLDALDAIGLVRYCCRRMLMTHVDLIEKLLNYNTLEKSDAN

SEQ ID NO: 209 - protein, 51 aa, A. thaliana
MDPAPEPVTYVCGDCGQENTLKSGDVIQCRECGYRILYKKRTRRVVQYEAR

SEQ ID NO: 210 - protein, 52 aa, A. lyrata
MEPAQPEPVTYVCGDCGQENTLKPGDVIQCRECGYRILYKKRTRRVVQYEAR

SEQ ID NO: 211 - protein, 51 aa, C. Sativus
MDPQPEPVSYICGDCGMENTLKQGDVIQCRECGYRILYKKRTRRIVQYEAR

SEQ ID NO: 212 - protein, 51 aa, V. Vinifera
MDPQPEPVSYICGDCGQENTLKPGDVIQCRECGYRILYKKRTRRIVQYEAR

SEQ ID NO: 213 - protein, 51 aa, M. Truncatula
MDPLPEPVSYLCGDCGVENTLKSGDVIQCRDCGYRILYKKRTRRIVQYEAR

SEQ ID NO: 214 - protein, 51 aa, R. Communis
MDPQPEPVSYICGDCGMENTLKQGDVIQCRECGYRILYKKRTRRSSELSRM

SEQ ID NO: 215 - protein, 51 aa, G. max
MDPQPEPVSYICGDCGMENTLKPGDVIQCRECGYRILYKKRTRRIVQYEAR

SEQ ID NO: 216 - protein, 52 aa, Z. mays
MDPQQPEPVSYLCGDCGAENTLKPGDVIQWRECGYRILYKKRTRRIVQYEAR

SEQ ID NO: 217 - protein, 52 aa, O. Sativa
MDPQQPEPVSYLCGDCGAENTLKPGDVIQCRECGYRILYKKRTRRIVQYEAR

SEQ ID NO: 218 - protein, 52 aa, B. Distachyon
MDPQQPEPVSYLCGDCGAENTLKSGDVIQCRECGYRILYKKRTRRIVQYEAR

SEQ ID NO: 219 - protein, 62 aa, P. trichocarpa
CGMENTLKPGDVIQCRECGYRILYKKRTRRIVFNLRVLVRVVKLRSFGSLMWSHCCLVVSAS

SEQ ID NO: 220 - protein, 104 aa, B. Napus
MNLLRPFNVSLSLSLSLSLSLSLVSSLVFETIARINPNSAETLALSGKIRVDRMDQQPEPVTYVCGDCGQENTLKSGDVIQCRECGYRILYKKRTRRVVQYEAR

SEQ ID NO: 221 - protein, 144 aa, A. thaliana
MADDDYNEVDDLGYEDEPAEPEIEEGVEEDADIKENDDVNVDPLETEDKVETEPVQRPRKTSKFMTKYERARILGTRALQISMNAPVMVELEGETDPLEIAMKELRQRKIPFTIRRYLPDMSYEEWGVDELIVEDSWKRQVGGD

SEQ ID NO: 222 - protein, 144 aa, A. lyrata
MADEDYNEVDDLGYEDEPVEPEIEEGVEEDADIKENDDVNGEPMETEDKVETEPVQRPRKTSKFMTKYERARILGTRALQISMNAPVMVELEGETDPLEIAMKELRQRKIPFTIRRYLPDGSFEEWGVDELIVEDSWKRQVGGD

SEQ ID NO: 223 - protein, 142 aa, C. Sativus
MADDDYNDLDMGYEDEPPEPEIEEGAEEELDTNTDDVPGEPVEAEGKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 224 - protein, 141 aa, V. Vinifera
MADDDYNDMDMGYEDEPPEPEIEEGAEEDADNNNNEDIPDAIETAEKEQVPVERSRKTSKYMTKYERARILGTRALQISMNAPVMVELEGETDPLEIAMKELRERKIPFTIRRYLPDGSYEDWGVDELIVEDSWKRQVGGD

SEQ ID NO: 225 - protein, 145 aa, M. Truncatula
MADDDYEDIDMGYEEEPPEPEIEEGAEEEDPDNKNDDLDAEGEPIETEEKEDAAPVERPRRTSKYMTKYERARILGTRALQISMNAPVMVELEGETDPLEIAMKELRERKIPFTIRRYLPDGSYEDWGVDELIVEDSWKRQVGGD

SEQ ID NO: 226 - protein, 124 aa, R. Communis
MIWQEGAEEDVENNNNEDVPGDPIETEDKEEQEAAERPRKTSKYMTKYERARILGTRALQISMNAPVMVELEGETDPLEIAMKELRERKIPFTIRRYLPDGSYEDWGVDELIVEDSWKRQVGGD

SEQ ID NO: 227 - protein, 142 aa, G. max
MADDDYEDIDMGYEDEPPEPEIEEGAEEDLENKNDELTGEPIDTEDKEEEQPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 228 - protein, 142 aa, Z. mays
MADDDYNEIDMGYEDEPPEPEIEEGAEEELENNEDAPDDVIGGEGEDKEQEKTKRERKTTKYMTKYERARILGTRALQISMNAPVMVELEGETDPLEIAMKELRARKIPFTIRRYLPDGSYEDWGVDELIVEDSWKRQVGGD

SEQ ID NO: 229 - protein, 143 aa, S. Bicolor
MADDDYNEMDMGYEDEPPEAEIEEGAEEELENNNEDTPDDVVGAEAEDKEQEKIARARKTTKYMTKYERARILGTRALQISMNAPVMVELEGETDPLEIAMKELRARKIPFTIRRYLPDGSYEDWSVDELIVEDSWKRQVGGE

SEQ ID NO: 230 - protein, 142 aa, O. Sativa
MADDDYNDMDMGYEDEPPEPEIEEGAEEEPENNEDGPDEVVGAEAEDKEQEKTQRPRKTSKYMTKYERARILGTRALQISMNAPVMVELEGETDPLEIAMKELRARKIPFTIRRYLPDGSYEDWGVDELIVEDSWKRQVGGG

SEQ ID NO: 231 - protein, 142 aa, B. Distachyon
MADDDYNEVDMGYEDEPAEPDIEEGVEEDPENNEDAPEDVVGGEGEEKEQEKTPRPRNTSKYMTKYERARILGTRALQISMNAPVMVELEGETDPLEIAMKELRARKIPFTIRRYLPDGSYEDWGVDELIVEDSWKRQVGGG

SEQ ID NO: 232 - protein, 143 aa, P. trichocarpa
MADDEYNDVDMGYEDEPAEPEIEEGADEDAENNNNEDDTGEPIETEDKEEQAPVERPRKTSKFMTKYERARILGTRALQISMNAPVMVELEGETDPLEIAMKELRERKIPFTIRRYLPDGSYEDWGVDELIVEDSWKRQVGGD

SEQ ID NO: 233 - protein, 144 aa, B. Napus
MAEDDYNEVDDLGYEDEPAEPEIEEGIEEDADMKDNDDINGEPLETEDKVETEPVQRPRKTSKFMTKYERARILGTRALQISMNAPVMVELEGETDPLEIAMKELRQRKIPFTIRRYLPDGSFEEWGVDELIVEDSWKRQVGGD

SEQ ID NO: 234 - protein, 144 aa, A. thaliana; identical to SEQ ID NO: 221

SEQ ID NO: 235 - protein, 144 aa, A. lyrata; identical to SEQ ID NO: 222

SEQ ID NO: 236 - protein, 143 aa, C. Sativus
MADDDYNDLDMGYEDEPPEPEIEEGAEEELENNNNDDIPGEPVEAEEKEDEEPIVRARKTSKFMTKYERARILGTRALQISMNAPVMVELEGETDPLEIAMKELRERKIPFTIRRYLPDGSYEDWGVDELIVEDSWKRQVGGA

SEQ ID NO: 237 - protein, 140 aa, V. Vinifera
MNVYQRSLRKKCNKVRTAYTFDEGAEEDADNNNNEDIPDAIETAEKEQVPVERSRKTSKYMTKYERARILGTRALQISMNAPVMVELEGETDPLEIAMKELRERKIPFTIRRYLPDGSYEDWGVDELIVEDSWKRQVGGD

SEQ ID NO: 238 - protein, 144 aa, M. Truncatula
MADDDYNDLDIGYEDEPPEPGIEEGAEVDADDNDNNDEMAGEPIETEEKEQEEPTERPRKTSKYMTKYERARILGTRALQISMNAPVMVELEGETDPLEIAMKELREKKIPFTIRRYLPDGSYEDWGVDELIVEDSWKRQVGGD

SEQ ID NO: 239 - protein, 124 aa, R. Communis; identical to SEQ ID NO: 226

SEQ ID NO: 240 - protein, 142 aa, G. max; identical to SEQ ID NO: 227

SEQ ID NO: 241 - protein, 142 aa, Z. mays
MADDDYNEIDMGYEDEPPEPEIEEGAEEEPENNEDAPDDVIGGEGEDKEQEKTKRERKTTKYMTKYERARILGTRALQISMNAPVMVELEGETDPLEIAMKELRARKIPFTIRRYLPDGSYEDWGVDELIVEDSWKRQVGGD

SEQ ID NO: 242 - protein, 143 aa, S. Bicolor; identical to SEQ ID NO: 229

SEQ ID NO: 243 - protein, 142 aa, O. Sativa; identical to SEQ ID NO: 230

SEQ ID NO: 244 - protein, 142 aa, B. Distachyon; identical to SEQ ID NO: 231

SEQ ID NO: 245 - protein, 143 aa, P. trichocarpa; identical to SEQ ID NO: 232

SEQ ID NO: 246 - protein, 144 aa, B. Napus; identical to SEQ ID NO: 233

SEQ ID NO: 247 - protein, 146 aa, A. thaliana
MASNIILFEDIFVVDQLDPDGKKFDKVTRVQATSHNLEMFMHLDVNTEVYPLAVGDKFTLALAPTLNLDGTPDTGYFTPGAKKTLADKYEYIMHGKLYKISERDGKTPKAELYVSFGGLLMLLKGDPAHISHFELDQRLFLLMRKL

SEQ ID NO: 248 - protein, 146 aa, A. lyrata
MASNIILFEDIFVVDKLDPDGKKFDKVTRVQATSHNLEMFMHLDVNTEVYPLAVGDKFTLALAPTLNLDGTPDTGYFTPGAKKTLADKYEYIMHGKLYKISERDGKTPKAELYVSFGGLLMLLKGDPAHISHFELDQRLFLLMRKL

SEQ ID NO: 249 - protein, 146 aa, C. Sativus
MAGLLFNDIFKVKCVNPDGKKYDKVSRIEARSEKLSMHMLLDVNTEIYPIDEGEKLLMVLSPTLNYDGSPVTSYKDQEGKKSLADKFEYIMHGKTYKLSDEGSGSDLKVEVYASFGGLQMLLKGDPIHCAKFRVDQNMFLLLRKLT

SEQ ID NO: 250 - protein, 305 aa, V. Vinifera
  VARIANT 86, 160, 170, 181, 268: Xaa = Any Amino Acid
MENTLFGDIFKVIQIDPDGKKFDKVSRIEAQSEQLDMYMQLDVNTEIYPMHAGEKFAMSLASTLDLDGTPDTGYYTQVKCCGMVVXLARTKRITAAVRVAGRKSLADKFEYVMHGKLYKISEEGSGPNVKGVIYVSFGGLLMMLSGDPANTAKLDLDQRXFLLIRKFKDXTLIPSCEYLLXRDNFAVTMVETFFDDIFVVDGQDPGGKKFDKVSRIEASSEQYDMFMQLDVNIEAYPIQAGEKFRMVLAPTLHLDGADVTDYFTQGEXKSLADKFDYVMYGIIYKVSNEGSGPDVKGYISILFRH

SEQ ID NO: 251 - protein, 145 aa, M. Truncatula
MVESLLEDIFRVEKVNPDDKKLFEKVTRIEARSEKFDMFMQLDINSELYPLKMGQKFSLALVPTLNPDGTPDTGYYNPGNRQSIADNYEYVMYGKLYRVTEGSGGREKAELNISFGGLLMLLKGDHSHFNKFELDQRLYLLMRKV

SEQ ID NO: 252 - protein, 146 aa, R. Communis
MSNIVLFEDIFVVDKLDPDGKKFDKVSRIEAHSQNCDMFMHLDVNTEIYPMAVGDKFTMALAHTLNLDGTPDTGYYTQGARKTLADKYEYIMNGKLYKISEEGSGKAVKAEMLVSYGGLLMLLRGDPSHVSHFELDQRLFLLMRKL

SEQ ID NO: 253 - protein, 145 aa, G. max
MVENNLFEDIFRVEKLNPDDKKLFDKVTRIEARSEKFDMFMHLDINSEIYPLKVGQKFALVLVSTLNPDGTPDTGYYTQISRQSLANNFEYVMYGKLYRITEGSGREKAEMNISFGGLLMMLKGDTSHCNKFELDQRLYLLIRKV

SEQ ID NO: 254 - protein, 146 aa, Z. mays
MSEHLFEDTFVVTRLDPDGKKFDRVSRVEARSEQLDMYMQLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 255 - protein, 145 aa, S. Bicolor
MSEHLFEDTFIVSRLDPDGKKFDKVSRVEARSEQLGMYMQLDVATDVYPLRAGEKFNMVLAPTLNLDGTPDTGYYTQAGRKTLADNYEYVMQGKLYKISEDTSSQNAKVEIYASFGGLLMLLRGDPSTAASFELDQRLFLLMRKV

SEQ ID NO: 256 - protein, 148 aa, O. Sativa
MAEFLFEDIFTVTRLDPDGKKFDRVSRIEARSDQFDMYMQLDVATDVYPMHPGDRFTMVLVPTLNLDGTPDSAFFTQAGRKTLADKYEYVMHGKLYKISEDKDTSDQNAKKVEMYASFGGLLVMLKGDPSSAANFELDQRLFLLMRKV

SEQ ID NO: 257 - protein, 116 aa, B. Distachyon
MAEHLFEDIFVVNRIDPDGKKFDRVNRIEARSEQFHMYMQLDVATYVYPMHAGDKFTMVLAPTLNLDGTPDTGYYTQAGRKTLADKYDYVMHGKLYKISEDSSGGQAAKVYDFSKL

SEQ ID NO: 258 - protein, 148 aa, P. trichocarpa
MSSSNIIMFEDIFVVDKLDPDGKKFDNVTRIEAHSQNCDMFMHLDVNTDVYPMFVNDKFTMALAHTLNLDGTPDTGYYTQGGRKTLADKYEYVMHGKLYQIQEEGSRRATRTEMVITFGGLLMLLKGDPSYVSQFELDQRLFCLIRKL

SEQ ID NO: 259 - protein, 146 aa, B. Rapa
MASSIIMFEDIFVVDKLDPDGKKFDKVTRIEATSHNLDMFMHLDVNTEVYPMAVGDKFTLAMAPTLNLDGTPDTGYFTPGAKKTLADKYEYVMHGKLYKITERDGQTPKAEMYVSFGGLLMLLRGDPAHISHFELDQRLFLLMRKL

SEQ ID NO: 260 - protein, 146 aa, A. thaliana
MASNIIMFEDIFVVDKLDPDGKKFDKVTRVEARSHNLEMFMHLDVNTEVYPLAVGDKFTLAMAPTLNLDGTPDTGYFTPGAKKTLADKYEYIMHGKLYKISERDGKTPKAELYVSFGGLLMLLQGDPAHISHFELDQRLFLLMRKL

SEQ ID NO: 261 - protein, 146 aa, A. lyrata; identical to SEQ ID NO: 248

SEQ ID NO: 262 - protein, 146 aa, C. Sativus; identical to SEQ ID NO: 249

SEQ ID NO: 263 - protein, 145 aa, V. Vinifera
MENTLFGDIFKVIQIDPDGKKFDKVSRIEAQSEQLDMYMQLDVNTEIYPMHAGEKFAMSLASTLDLDGTPDTGYYTQAGRKSLADKFEYVMHGKLYKISEEGSGPNVKGVIYVSFGGLLMMLSGDPANTAKLDLDQRVFLLIRKV

SEQ ID NO: 264 - protein, 145 aa, M. Truncatula; identical to SEQ ID NO: 251

SEQ ID NO: 265 - protein, 146 aa, R. Communis; identical to SEQ ID NO: 252

SEQ ID NO: 266 - protein, 145 aa, G. max; identical to SEQ ID NO: 253

SEQ ID NO: 267 - protein, 146 aa, Z. mays; identical to SEQ ID NO: 254

SEQ ID NO: 268 - protein, 145 aa, S. Bicolor; identical to SEQ ID NO: 255

SEQ ID NO: 269 - protein, 148 aa, O. Sativa; identical to SEQ ID NO: 256

SEQ ID NO: 270 - protein, 144 aa, B. Distachyon
MAEHLFEDIFVVSRIDPDGKKFDRVNRIEARSEQMYMQLDVATDVYPMHAGDKFTMVLAPTLNLDGTPDTGYYTQAGRKTLADKYDYVMHGKLYKISEDSSGGQAAKVEIYASFGGLLMLLKGDPSSAANLELDQRLFLLMRKV

SEQ ID NO: 271 - protein, 148 aa, P. trichocarpa; identical to SEQ ID NO: 258

SEQ ID NO: 272 - protein, 146 aa, B. Rapa; identical to SEQ ID NO: 259

SEQ ID NO: 273 - protein, 222 aa, A. thaliana
MEVKGKETASVLCLSKYVDLSSEESHRYYLARRNGLQMLRDRGYEVSDEDINLSLHDFRTVYGERPDVDRLRISALHRSDSTKKVKIVFFGTSMVKVNAIRSVVADILSQETITGLILVLQNHVTNQALKAIELFSFKVEIFQITDLLVNITKHSLKPQHQVLNDEEKTTLLKKFSIEEKQLPRISKKDAIVRYYGLEKGQVVKVNYRGELTESHVAFRCVW

SEQ ID NO: 274 - protein, 222 aa, A. lyrata
MEVKGKETAPSLCLSKYVDPSSEESHRYYLARQNALQMLRDRGYQVSDEDINLSLHDFRAVYGERPDVDRLRISAQHRSDSSKKVKVVFFGTGMVKVNAIRSIAADVLSQETVTGLILVLQSQVTKQAMKAIELFSFKVEIFQITDLLVNITKHALKPQHRVLNDKEKTTLLKKFSIEEKQLPRISKKDAIVRYYGLEKGQVVKVNYRGELTESHVAYRCVW

SEQ ID NO: 275 - protein, 227 aa, C. Sativus
MEEDGFEAEPNPVEFGTCLSSYIDDGTTESHRYFLSRRTVVEMLKDRGYTINSPNIDFSLQQFRETFGQFPDVDRLKLSAAHHSDPSKRVLVVFCGTGAVKVNAIRNIAGQIANKDSLHGLILIVQNQITNQAMKAVELFSFKVEIFQITDLLVNITKHALKPNHQVLTEEEKQKLLKQYSIEEKQLPRMLRTDAIARYYGLEKGQVVKVTYDGDMTRAHITYRCVW

SEQ ID NO: 276 - protein, 229 aa, V vinifera
MDGGGWFDGDLNGDFEVKRCLSSFVDEGRIESHRYYLARRTLLEMLRDRGYSIPALDIDISLQDFRSFYSQKPDPDRLRISAALRSDPSKKILVIFCGPDVVKVNAIRSIATQIVNKDSLSKLILVLQNHITSQALKAVDLFSFQVEKFQITDLLVNITKHVLKPKHRVLTDQEKNKLLKKYSLNEKQLPRMLQQDAIARYYGLEKGQVVKVIYNGEITGSHVTYRCVW

SEQ ID NO: 277 - protein, 248 aa, M. Truncatula
MATENGGGQNGTTETAITTMEIENGDITTQPQLQEQPQCLFTKKDNGSIESHRYYLSRRTVLEMLKDRGYSIPSDEIQLSLDDFRQIHGQSPDVDRLRLTATHATNPSKRILVVFSGPGIVKVNGVRDIAGQIVNRESLTGLILIVQNQITSQALKAVNLLSFKVEIFQITDLLVNATKHVLKPKHQVLTDKQKKNLLKKYDIQEKQLPRMLQTDAIARYYGLQRGQVVKVTYTGEITQMHVTYRCVW

SEQ ID NO: 278 - protein, 239 aa, R. Communis
MATGADYLCLNGGGGGGGGGGDDRRGRVECLTKFVEQASLESQRYYLSRKTVMEMLRDRGYDVADSELTGSFTEFLSEFGDNPDILKLRISASLHSHPDKKMVVVFMGTEEIKLANIRGLLCQIKNKESLNGLILILQSKMNHYARKELGQFPSKVEIFHISDLLVNITKHVLKPRHEVLTAEQKQQLLNKFSSEDKQLPRMLVTDAISRYYGFEKGQVVKITYSGGLVDSLVTYRCVT

SEQ ID NO: 279 - protein, 237 aa, G. max
MAATEIGLLEWVRVGGEEEEEAEQAKGCLSKFVDNGSVESHRYYLSRRTTLEMLKDRGYSIPSHEIDLSLSDFRDIHGQFPDPDRLRLSLTHATNSSKRILVIFCGPGVVKVTAIRNTAGQIINRDTLTGLILIVENHITSQALKAVNLFSFKVEIFQITDLLVNITKHVLKPKHQVLTDKQKINLLKKYNIEEKQLPRMLQTDAIARYYGLERGQVVKVTYSGEVTQMHVTYRCVW

SEQ ID NO: 280 - protein, 264 aa, Z. mays
MDPHQFAPSQQSALTMESAEITAAAAAARAPNGAARAIVEDDDEDDDVPEVAACISTMLDRGGSVESHRLFLARRTALEMLRDRGYAVPEEELARTLPEFRAWWEYRPELERLAFSTTLASDPSSKVKVVFCPPGPVKIAAIRLIYTEVKDENLSRLILILQGKIMSTTRESIKEIFRFKVDTFQITELLVNITKHVLKPKHEVLTAEGKAKLLKEYNVVDSQLPRMLENDAVARYYGLGKGTVVKVIYDSELTGNHVTYRCIT

SEQ ID NO: 281 - protein, 263 aa, S. Bicolor
MDLNQFVPSQNSALTMDSAESTAAAAARAPNGAARAVDDYDDDDDAVPEVAACISAMLDLGGSVESKRLFLARRTALEMLRDRGYAVPEDELARTLPEFRAWWEDKPELERLAFSTTLASDPSSKVKVVFCPPEPVKIAAIRVVYTGVKDENLSRLILILQGRIMSKAREAIKEIFPYKVDTFQITELLVNITKHALKPKHQVLTAEEKAKLLKEYNVVDSQLPRMLENDAVARYYGLGKGTVVKVIYDSELTGNHVTYRCIF

SEQ ID NO: 282 - protein, 227 aa, O. Sativa
MAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVTYDGELTGKRVAYRCVF

SEQ ID NO: 283 - protein, 255 aa, B. Distachyon
MDSAESSVASTPARAPAVAPKAAVGPRYNNDGGDDDDDGVPMVARCVSSMIDSGDPESHRLFLARRTALEMLRDRRYAVPEADLARTLPEFRAWWAERPEIDRLSFSTTLASDPSNKVQLVFCPPEPFKIAAIREVYGRVKDENLSCLILVLQSKITSRAKDAIKEIFKYKVDVFQIAELLVNVTKHVLKPEHEVLTPEEKAHLLKKYNVVDSQLPRMLETDAIARYYGLGKGTVLRVTYDGELTGNHVTYRCIF

SEQ ID NO: 284 - protein, 243 aa, P. trichocarpa
MEQNLLTERPNEEEGGAHQEKENGSFGMESLGRCLSSFVDEGSTESHRYYLSRRTVLEMLKDRGYSVPSSEIDISLQDFRGVYGQNPDIELLKFSATHKSDPSKRMLVIFCGLGVVKVGMIRLITVQITDRDSLTGLILVLQNNITNQAMKALDLFKFKIEIFQITDLLVNITKHILKPKHQVLSEQAKQRLLKKYSIEEKQLPRLLKKDAISRYYGLERGQVVKVTYDGDITGSHVTYRCVW

SEQ ID NO: 285 - protein, 230 aa, B. napus
MEGIGNDKSSCSSSSTVPGPCLSKYVDPSSEESHRYYLARRNALEMLRDRGYEVSLEDTNLSLQDFRTVYGERPDVDRLRISAHHRSDSSNKVKVVFFGTSKVKVNTIRSVAAEILSQETITGLILVLQNQVTDKALKAIELFTFKVEIFQITDLLVNLTKHVLSLRHRVLTDGEKKALLKHFNIEEKQLPRISKKDAVVRYYGLEKGQVVKVSYRGELTESYVAYRCVW

SEQ ID NO: 286 - protein, 205 aa, A. thaliana
MSEKGGKGLKSSLKSKDGGKDGSSTKLKKGRKIHFDQRTPPANYKILNVSSDQQPFQSSAAKCGKSDKPTKSSKNSLHSFELKDLPENAECMMDCEAFQILDGIKGQLVGLSEDPSIKIPVSYDRALAYVESCVHYTNPQSVRKVLEPLKTYGISDGEMCVIANASSESVDEVLAFIPSLKTKKEVINQPLQDALEELSKLKKSE

SEQ ID NO: 287 - protein, 210 aa, A. lyrata
MSEKGGKGLKSSLKSKDGFLVAGGKDGNSTKLKKGRKIHFDQGTPPPNYKILNGSSDPLPFQSSAAKVGKGDKPTKSSKNSLQSFELKDLPENAECMMDCEAFQILDGIKGHLVGLSEDPSIKIPVSYDRALAYVDSCVHYSNPQSVRKVLEPLKTHGVSDGEMCVIANASPDTVDEVLAFIPSLKAKKEVINQPLQDALVELAKLKKSG

SEQ ID NO: 288 - protein, 220 aa, C. Sativus
MSEKGEKGFSVQKRPAKSSLKSSALKDASLKGKDDSLSKLKKGRKVQFDAQGSVDATNTFSMKYSGKNGDLGKGGKGANTKASIAKEPQALELKIEQELPKNVKCQCLMDCEAAQLLQGIQDQMVFLSADPTIKIPTSFDRGLQYAKRANHYVNAESVRPVLETLKKYGVTDSEICVIANVCPDTTDEVFALLPSLKRKRSKLSEPINNVLSELAKVKSS

SEQ ID NO: 289 - protein, 235 aa, V. Vinifera
MGEKGGKGFSLNSNLGKSSTKSPLEGKDDSAAKSKRGRKVQFNNGGLPEARLTSSLMSGGKTDIPIAKGDLSKGGKGGRVLNGEKSAVPKPPAPLELRIEQELPKNAKCMMDCEAALILKGIQEQMVVLSEDPTIKIPLSFNKGLQYAQSSNCYASPQSVRLVLEPLSKYGVSDGEICVIANTCPETIDEVFALVPSLKPKWSTLREPLKDVLRGLAELKHSNQSSNPERSPGFS

SEQ ID NO: 290 - protein, 201 aa, M. Truncatula
MSDKGGKGGSLLSKGGLKGKDDSATKSAKARKVQFSEGLFESRSNGPTSGGKGDKVANGGKSSAAKDPHQFEHRVDQELPENFKCLMDCEAAVMLQGIQDQMVALSRDPSIKMPASFDKGLYYAKSSSSSKYSNPESVRHTLEPLMNHDLTESEICVIANVCPETADEVFALLPSLKSKRGINSQPVEEALSELAKFKQMI

SEQ ID NO: 291 - protein, 203 aa, R. Communis
MEKGGKGFSLPGKGLKSSLKSITPASTKGKDDTSAKSKRGKKVQFNSQGNMSKGGKGDKVSNGVKISSTKEPQPLELKIEQDLPKNAKCLMDCEAAQVLQGIQEQMVLLSRDPTIKLPVSFDRALQHARTGARFTNPQSVRRILEGLKKHGVSEGEICTIANVCPDGVDEVFALVPSLKSKKNVLREPLKDILGQLSELKQQA

SEQ ID NO: 292 - protein, 211 aa, G. max
MEKGGKGASLFSKGGLGSLKGKDDIATKSAKGRRVQFSTDGPLFESGVSSNSATSLKSGGKGGMGDNVAKGGKNSQSKDSHPSDYRVDQKLPENIKCLMDCEAVDILQGIQERMVMLSRDSTVKMPISFDKGLQYAKSNSKYLDLQSIRHILDRLAKCGVTDSEICVIGNVCPETIDEVFALLPSLKDRRNIDSQVLKDSLSELAKFRQTM

SEQ ID NO: 293 - protein, 219 aa, Z. mays
MDQVPNGRHKVSFAKPRVVVLSDSDSDSEGFVEELTPVHSKSNGKASSASLKTGGKASALSKGEASKGKAYSSDKGGKGSSSHAVPTKSDAELKLELDIPPNSRMLMNCEAAELLQEIHEHMAILSEDPKIKIPESFDKAFQYSKDGNHFTTASSVKQAIEPLKKCGVSDGEICMIANIGPETVEEVYALVPSLKANRSAIEGSVTEVLTALANIKAAK

SEQ ID NO: 294 - protein, 143 aa, S. Bicolor
MSGEEEENAAELKIGEEFLKAKCLMNCEVAIILEHKYEQIQQHSSESDPSSQVSQVFEKSLQYVKRFSRYKNPDAVRQVRETLSRYGLAEFELCTLGNLCPDTSGEATALVPSLKSGGRFVGDARDEKIEKMLNDLSLIKKFE

SEQ ID NO: 295 - protein, 239 aa, Oryza sativa
MAERGSRGFSAASKGKAIASKKDLPMNVFTGSLRQNSSANIPHVNIDSDSDSEGFVEELPRVNSKTNGKAASESLKTGGKASSKGQTGKGGNAGKGGKGSASARVSAKSDAELKLELDMPPNSCILMNCEVAELLQEIHEHMAILSEDPKIKIPESFDKAFQYVKEGNQFSTAQSVKQVLDPLRKYGVSDGEMCLIANVGPETIEEVYALVPSLKATRSLNESPIMEALTALADIKAAK

SEQ ID NO: 296 - protein, 238 aa, B. Distachyon
MSDRGGKGYYTAPRGKALASKTGTPNGRQNISANAPIVLSDSDSDSEGFREEPTPTHSKSNGKASSDSLKTGGKASSFSNGEAGKGGKTFSAGKGGKGSASTAMPAKSDAELKLELDMPSNSRILMNCEATELLQQIHEHMAILSEDPKIKIPESFDRTFQFAKEGNHFTSAKSVKEVLDPLKKSGVTDGEICMIANIGPETIEEVYALVPSLKATRSLNEDLITEALTALANIKAPK

SEQ ID NO: 297 - protein, 197 aa, P. trichocarpa
MEKGGGKGFSLPSKEPKSSLKSSSTKGKDDSNNGRKIHFESEGNLSKGGKGGKIANGGKSPMTKEPPPLELKIESELPQNAKPLMDCEAAQILQGIQDQMVLLSQDPTIKLPVSFDKGLQYAKNGAHYTNPQSVRRVLEALRKYGVSDGEISLIANVFPETADEAFALVPSLKSKASTLREPLKDILGELAKFKQPA

SEQ ID NO: 298 - protein, 209 aa, B. Napus
MSEKGGKGFKSSLKSSYGSGKDDNATKSKKTRKVQFDPQGPRESKYTFLQESDDQIQGSSAKGGKGSKARKSTLSKESQPLELKTDKELPENAKCLMDCEAFEILQGIKEQMAVLSEDPSVKLPVSFDRGLEYVKYGRCYMNPQSVRQILEPLKKHGVSESEMCVIANVCPESIDEVFAFVPSMKGRKDKISEPLEEALMKLSKLKRSA

SEQ ID NO: 299 - protein, 178 aa, A. thaliana
MFLKVQLPWNVMIPAENMDAKGLMLKRAILVELLEAFASKKATKELGYYVAVTTLDKIGEGKIREHTGEVLFPVMFSGMTFKIFKGEIIHGVVHKVLKHGVFMRCGPIENVYLSYTKMPDYKYIPGENPIFMNEKTSRIQVETTVRVVVIGIKWMEVEREFQALASLEGDYLGPLSEE

SEQ ID NO: 300 - protein, 178 aa, A. lyrata
MFLKVQLPWNVMIPAENMDAKGLILKRAILVELLDAFASKKATKELGYYVAVTTLDKIGEGKIREHTGEVLFPVMFSGMTFKIFKGEIIHGVVHKVLKHGVFMRCGPIENVYLSYTKMPDYKYVPGENPIFMNEKTSRIQVETTVRVVVIGIKWMEAEREFQALASLEGDYLGPLSEE

SEQ ID NO: 301 - protein, 175 aa, C. Sativus
MFLKVQLPWNVIIPAENLDAKGLMLQRSIIIRLLDEFATKKATKDLGYFLAVTTLENIGEGKVRQTGDVLFPVIFSGITFKLYRGEILEGVVHKVLKHGVFLRCGPVENIYLSYLKMPDYRYVPGENPVFLNDKLSKIEKDVVVRFIVIGTKWLEAEREFQALVSLEGDYLGPVS

SEQ ID NO: 302 - protein, 177 aa, V. Vinifera
MFLKVQLPWNVIIPAECLDAKGLMLQRSIIIRLLDAFSNKKATQELGYFLAVTTLENIGEGKVRQHSGDVLFPVVFSCVTFKLFRGEILDGVVHKVLKHGVILRCGPVENIYLSCQKMPDYRYVPGENPVFLNEKLSKIEKDVVVRFIVMGTKWLEAEREFQALVSLEGDYLGPLSD

SEQ ID NO: 303 - protein, 180 aa, M. Truncatula
MFLKVQLPWNVIIAAENLKPGSLMLQRAILIRLLSDFAAKKATKDMGYFLAVTTLDKIGEGKVRQHTGDVLFPVVFNAVTFKIFKGEVLEGVVHKVLKHGVFMRIGPIENAYLSSSKMPGYVYVLGENPYFMNQKMPKIAKDVKVRVVVIGTKWMEAEREFQALVGLEGDYLGPISSPDM

SEQ ID NO: 304 - protein, 176 aa, R. Communis
MYLKVQLPWNVIISAEHLDAKGLMLQRSIIIRLLEDFASKKATKDLGYYLAVTTLESIGEGKVREHTGDVLFPVVFNGITFKIFRGEILEGVVHKVLKHGVFIRCGPIENIYLSCMKMPDYHYVPGENPVFLNDKTSKIEKDVVVRFIVIGTKWLEAEREFQALVSLEGDYLGPVS

SEQ ID NO: 305 - protein, 197 aa, G. max
MIKIGSVGVAVTRKKQTMFLKVQLHWNVIIAAENLQPEGLMLHRAIIVRLLSDFAVKKATKDLGYFLAVTTLEKIGEGKVRQHTGDVLFPVVFNVITFKFFKGEILEGVVHKVLKHGVFMRCGPIENVYLSNLKMPDYRYVPGENACFMNDKMSKIGKDVTVRFSVIGTKWMEAEREFQALVSLEGDYLGPISTPDI

SEQ ID NO: 306 - protein, 175 aa, Z. mays
MVFLEAEMSWNVLISPSQLDRKGLLLRKAIIVRLLEDVTNRRASKEHGYYIAVNQLKAISEGKVRELTGDVLFPVSFTCITQKPMKGEVMVGHVDRILKHGVFLKSGPVESIFLAEKSMSNYKYIGGENAMFMNDHSKLEKDTAVRFKVLGFRWMEADRQFQLLATIAGDFLGPL

SEQ ID NO: 307 - protein, 175 aa, S. Bicolor
MVFLEAEMSWNVLISPSQLDRKGLLLRKAIIVRLLEDVTNRRASKEHGYYVAVSQLKAISEGKVRELTGDVLFPVSFTCITLKPMKGEVMVGHVDRILKHGVFLKSGPVESIFLAEKSMSDYKYIGGENAMFMNDHSKLEKDTAVRFKVLGFRWMEADRQFQLLATIAGDFLGPL

SEQ ID NO: 308 - protein, 175 aa, O. Sativa
MVFLKVEMSLNVLISPSQLSPQGLLLRKAVIVRLLEDIANRKASKDHGYYIAVSELKAISEGKVRELTGDVLFPVTFTCITQKPMKGEVLVGSVDKILKHGIFLKSGPIESIFLSEKTMSDFKYIGGENAVFMNEHSKLEKDTVVRFKVMGFRWMEADRQFQLLATLAGDYLGPL

SEQ ID NO: 309 - protein, 175 aa, B. Distachyon
MVFLLADMSWNVLISPDQLSSKGLLLRKSILVRLLEDIANRKASKEHGYYIAVNELKEISEGKVRELTGDVLFPVTFTCITLKPMKGEILVGSVEKILKHGVFLKSGPIENVFLSEKTMNDYKYIGGENPMFMKDHSKLEKDTVLRFKAMGFRWMEADRQFQLLATLAGDFLGPL

SEQ ID NO: 310 - protein, 176 aa, P. trichocarpa
MFLKVQLPWNVIIPAENLDAKGLMLQRSIVVRLLDDFAKKGATKDLGYYLAVSTLESIGEGKVRQHTGDVLFPVVFSGITFKIFRGEILDGIVHKVLKHGVLLRCGPIENIYLSCMKMPDYRYVPGENPVFLNDKTSKIEKDVVVRFVVLGTKWLEAEREFQALVSLEGDYLGPVS

SEQ ID NO: 311 - protein, 233 aa, B. Napus
MGLYILETKGLVSFRYRALEQLVDTLESEELCVFLPDRSVVASDLFFPVKPSYSVERKMFIKVKLPWNVMIPAEAMDPNGLMIQRAVLIRLLDAFASKKATKDLGYFIALKNLEEIGEGRIRETTGEIVFPVVFSGITFKMFKGEIVHGVVRQVHKSGVFLRCGPCENVYLSQYKMPGYDYVVQGNPLFMNQNMSRIQIGSTVRVIVLDIQWKEAEKEFIALASLEGNNLGPF

SEQ ID NO: 312 - protein, 174 aa, A. thaliana
MFIKVKLPWDVTIPAEDMDTGLMLQRAIVIRLLEAFSKEKATKDLGYLITPTILENIGEGKIKEQTGEIQFPVVFNGICFKMFKGEIVHGVVHKVHKTGVFLKSGPYEIIYLSHMKMPGYEFIPGENPFFMNQYMSRIQIGARVRFVVLDTEWREAEKDFMALASIDGDNLGPF

SEQ ID NO: 313 - protein, 174 aa, A. lyrata
MFIKVKLPWDVTIPAEDMDTGLMLQRAIVIRLLEAFGTKKATKDLGYLITPTILENIGEGKIKEQTGEIQFPVVFNGICFKMFKGEVVHGVVQKVHKSGVFLRSGPYEIIYLSHVKMPGYEFIPGEKPIFMNQNMSRIQIGARVRFIVLDTEWREAEKDFMALASIDGDNLGPF

SEQ ID NO: 314 - protein, 175 aa, Cucumis sativus; identical to SEQ ID NO: 301

SEQ ID NO: 315 - protein, 177 aa, V. Vinifera; identical to SEQ ID NO: 302

SEQ ID NO: 316 - protein, 180 aa, M. Truncatula; identical to SEQ ID NO: 303

SEQ ID NO: 317 - protein, 176 aa, R. Communis; identical to SEQ ID NO: 304

SEQ ID NO: 318 - protein, 198 aa, G. max
MIKIGSVGVAVSTRKKQTMFLKVQLHWNVIIAAENLQPEGLMLHRAIIVRLLSDFAVKKATKDLGYFLAVTTLEKIGEGKVRQHTGDVLFPVVFNVITFKFFKGEILEGVVHKVLKHGVFMRCGPIENVYLSNLKMPDYRYVPGENACFMNDKMSKIGKDVTVRFSVIGTKWMEAEREFQALVSLEGDYLGPISTPDI

SEQ ID NO: 319 - protein, 175 aa, Z. mays; identical to SEQ ID NO: 306

SEQ ID NO: 320 - protein, 175 aa, S. Bicolor; identical to SEQ ID NO: 307

SEQ ID NO: 321 - protein, 175 aa, O. Sativa
MVFLKVDMSWNVLISPSELSPKGLLLRKAVIVSLLEEIANRKASKDHGYYIAVSELKAISEGKVRELTGDVLFPVTFTCITQKPTKGEILVGSVDKILKHGVFLKSGPIESIFLSEKTLSDYKYIGGENPMFMNDHSKLEKDTAVRFKVMGFRWMEADRQFQILATLAGDYLGPL

SEQ ID NO: 322 - protein, 175 aa, B. Distachyon; identical to SEQ ID NO: 309

SEQ ID NO: 323 - protein, 176 aa, P. trichocarpa; identical to SEQ ID NO: 310

SEQ ID NO: 324 - protein, 233 aa, B. Napus; identical to SEQ ID NO: 311

SEQ ID NO: 325 - protein, 205 aa, A. thaliana
MLTEEELKRLYRIQKTLMQMLRDRGYFIADSELTMTKQQFIRKHGDNMKREDLVTLKAKRNDNSDQLYIFFPDEAKVGVKTMKMYTNRMKSENVFRAILVVQQNLTPFARTCISEISSKFHLEVFQEAEMLVNIKEHVLVPEHQVLTTEEKKTLLERYTVKETQLPRIQVTDPIARYFGLKRGQVVKIIRPSETAGRYVTYRYVV

SEQ ID NO: 326 - protein, 205 aa, A. lyrata
MLTEEEIKRLYRIQKTLMQMLKDRGYFIADSELTMTKQQFIRKHGDNMKREDLVTLKVKRNDNSDQLYIFFPDEAKVGVKTMKMYTNRMKSENVYRAILVVQQNLTPFARTCISEISSKFHLEVFQEAEMLVNIKEHVLVPEHQVLTTEEKKTLLERYTVKETQLPRIQVTDPIARYFGLKRGQVVKIIRPSETAGRYVTYRYVV

SEQ ID NO: 327 - protein, 207 aa, C. Sativus
MVLSEEEITRLFRIRKTVFQMLRDRGYFVGDFEIDMTREQFKQKYGENMKREDIVINKSKRNDSSDQIYVFFPEEAKVGIKPLKTYTTRMKSENVFRAILVVQQNLTPFARACMSEATSKSFHLEVFQEAELLVNIKDHVLVPEHQLLNNEEKKTLLERYTVKETQLPRIQVTDPVARYYGLKRGQVVKIIRPSETAGRYVTYRYVV

SEQ ID NO: 328 - protein, 206 aa, V. Vinifera
MSASEEEISRLFRIRKTVMQMLKDRGYFVGDFEINMTKHQFVSKFGENMKREDLVINKAKRTDSSDQIYVFFPEEQKVGVKTMKTYTNRMKSENVFRAILVVQQNLTPFARTCINEISTKFHLEVFQEAELLVNIKEHVLVPEHQVLTSEEKKTLLERYTVKETQLPRIQVSDPIARYFGLKRGQVVKIIRPSETAGRYITYRYVV

SEQ ID NO: 329 - protein, 206 aa, M. Truncatula
MVFSEEEITRLYRIRKTVMQMLKDRNYLVGDFELNMSKHDFKDKYGENMKREDLVINKTKKDKPSDQIYVFFPEEAKVGVKTMKTYTNRMNSENVYRAILVCQTSLTPFAKTCVSEIASKFHLEVFQEAELLVNIKEHVLVPEHQILNDTEKKTLLERYTVKETQLPRIQVTDPVARYYGLKRGQVVKIIRPSETAGRYVTYRLVV

SEQ ID NO: 330 - protein, 225 aa, R. Communis
MTLSEDEIKRLFRIRRTVMQMLKDRTYLVTDSEINITKHQFTSKYGDNMKREDLVIHKSKRDGSDSFYPTKLLFLNQLEAWLPLYQIYVFFPEEQKVGVKTMKTYTNRMKSENVFRAILVVQQSLTPFARTCIAEIASKFHLEVFQESELLVNIKEHVLVPEHQVLTNEEKKTLLERYTVKETQLPRIQISDPIARYYGLKRGQVVKIIRPSETAGRYVTYRYVV

SEQ ID NO: 331 - protein, 206 aa, G. max
MVLSEEEMGRLYRIRKTVMQMLRDRGFLVGDFEINMSKHEFKSKYGEHMKREDLVINKSKKDNSGDQIYVFFPDEPKVGVKTMKTYTNRMNSENVYRAILVTQTNLTPFARTCISEISSKFHLEVFQEAELLVNIKEHELVPEHQVLTDAEKKTLLERYTVKETQLPRIQVTDPVARYYGLKRGQVVKIIRPSETAGRYVTYRFVV

SEQ ID NO: 332 - protein, 206 aa, Z. mays
MASPDDEISRLFRIRRTVYEMLRDRGYGVRDEQIKLERHKFIERYGNPVRRDELTFNATKLNGPSDQIYVFFPNEAKPGVKTIRNYVEKMKNENVFAGILVVQQALSAFARSAVQEVSQKYHLEVFQEAELLVNIKDHVLVPEHVLLTPEDKKTLLERYTVKETQLPRIQITDPIARYYGMKRGQVVKITRASETAGRYITYRYVV

SEQ ID NO: 333 - protein, 210 aa, O. Sativa
MSAGLVTEEVMVGRLVRIRRTVMQMLRDRGYLVVEHELAMGRRDFLRKYGESFHREDLLINKYKKNDPSDQIYVFFPNDDKVGMKHIKKYVEMMKAENVSRAVLVLQQNLTPFARSFLQELEPKIHLEIFQEAELLINIKEHVLVPEHQVLNNEEKKTLLERYTLKETQLPRIQITDPIARYYGLRRGQVVKIIRPSETAGRYVTYRYVV

SEQ ID NO: 334 - protein, 210 aa, B. Distachyon
MASGLVTDDAGVGRLVRIRSTVMHMLRDRGYLVVEHELAMTRRDFERKYGESFHREDLLINKCKKNDPNDQIYVFFPNDEKVGMKHIKKYVEMMNAEKVSRAVVVVQQNLTPFAKSFLQELEPKIHLEVFQDAEMLINIKEHVLVPEHQVLTNDEKKTLLERYTLKETQLPRIQITDPIARYYGLKRGQVVKIIRPSETAGRYVTYRYVV

SEQ ID NO: 335 - protein, 243 aa, P. trichocarpa; identical to SEQ ID NO: 284

SEQ ID NO: 336 - protein, 206 aa, B. Napus
MGLTEEEIKRIYRIQKTLMQMLKDRGYFIADSEITMTLSQFVRKHGDNMKREDLVTLRAKRNDSSDQLYVFFPDEVKVGINTMKVYTNRMKSENVYRAILVVQQNLTPFARNCISQISSKFHLEVFQEAEMLVNIKEHVLVPEHQVLTTEEKKTLLERYTVKETQLPRIQVTDPIARYFGLKRGQVVKIIRPSETAGRYVTYRYAV

SEQ ID NO: 337 - protein, 114 aa, A. thaliana
MSTMKFCRECNNILYPKEDKEQKILLYACRNCDHQEVADNSCVYRNEVHHSVSERTQILTDVASDPTLPRTKAVRCSKCQHREAVFFQATARGEEGMTLFFVCCNPNCGHRWRE

SEQ ID NO: 338 - protein, 114 aa, A. lyrata
MSTMKFCRECNNILYPKEDKEQKILLYACRNCDHQEVADNSCVYRNEVHHSVSERTQILTDVASDPTLPRTKAVRCAKCQHSEAVFFQATARGEEGMTLFFVCCNPNCGHRWRE

SEQ ID NO: 339 - protein, 114 aa, C. Melo
MSTMKFCRECNNILYPKEDRDEKILLYACRNCDHQEVADNNCVYRNEIHHAVGERTQVLQDVAADPTLPRTKAVRCAQCNHGEAVFFQATARGEEGMTLFFVCCNPNCGHRWRD

SEQ ID NO: 340 - protein, 114 aa, V. Vinifera
MSTMKFCRECNNILYPKEDREQKILLYACRNCDHQEVAENNCVYRNEIHHSVGERTQVLQDVAADPTLPRTKSVRCAQCNHGEAVFFQATARGEEGMTLFFVCCNPNCGYRWRD

SEQ ID NO: 341 - protein, 114 aa, M. Truncatula
MSTMKFCRECNNILYPKEDREQKILLYACRNCDHQEAADNFCVYRNEIHHSVAERTQVLQDVAADPTLPRTKAVRCVQCNHGEAVFFQATARGEEGMTLFFVCCNPNCGHRWRD

SEQ ID NO: 342 - protein, 266 aa, R. Communis
MSVYKFCPDCNNVLYPKEDRKQRILLYACRNCEHQEVADSNRVYRNEIHHSVSEHTQILQDVASDPTLPRTKSVRCSACGHGEAVFLQGGGYDTVLRLLQSKLWQSMERLLRSSSRTKLFADEAMAVLMYGQCNIYFAKWRAVEPSHHWHIAFPENEINKLHNNILYPKEDRDQKILLYACRNCDHQEIAESNCVYRNEVHHSAAERTQVLQDVAADPTLPRTKAVECQVCKHPEAVFFQATARGEEGMTLFFVCCNPICGHRWRD

SEQ ID NO: 343 - protein, 114 aa, G. max
MSAMKFCRECNNILYPKEDRDQKVLLFACRNCDHQEVADNFCVYRNEIHHSVGERTQVLQDVAADPTLPRTKSVRCSQCNHGEAVFFQATARGEEGMTLFFVCCNPNCGHRWRD

SEQ ID NO: 344 - protein, 114 aa, Z.mays
MSTMKFCRECNNILYPKEDREQKVLLYACRNCDHQEVADNNCVYRNVVHHSAGEFTQVLQDVAGDPTLPRTKSVRCSSCGHGEAVFFQATARGEEGMTLFFVCCNPSCGNRWRE

SEQ ID NO: 345 - protein, 114 aa, S. Bicolor
MSTMKFCRECNNILYPKEDREQKVLLYACRNCDHQEVADNNCVYRNVVHHSAGEFTQVLQDVAGDPTLPRTKSVRCASCGHGEAVFFQATARGEEGMTLFFVCCNPSCGNRWRE

SEQ ID NO: 346 - protein, 114 aa, O. Sativa
MSTMKFCRECNNILYPKEDRDQKILLYACRNCDHQEVADNNCVYRNVVHHSAGEFTQVLQDVAGDPTLPRTKAVRCAVCGHGEAVFFQATARGEEGMTLFFVCCNPSCGHRWRE

SEQ ID NO: 347 - protein, 114 aa, B. Distachyon
MSAMKFCRECNNILYPKEDRDQKVLLFACRNCDHQEVADNNCVYRNVVHHSAGEFTQVLQDVAGDPTLPRTKEVRCAVCGHGEAVFFQATARGEEGMTLFFVCCNPSCGHRWRE

SEQ ID NO: 348 - protein, 114 aa, P. trichocarpa
MSTMKFCRECNNILYPREDRDQKILLYACRNCDHQEIADDNCVYRNEVHHSVAERTQVLQDVAADPTLPRTKAVTCTVCKHPEAVFFQATSRGEEGMTLFFVCCNPNCGHRWRD

SEQ ID NO: 349 - protein, 131 aa, B. Napus
MYIFPITIFNRFRRHDISYTMKFCRECNNILYPKEDKEQKILRYACRNCDYQEIADNYCVHRNEVHHSVSEKTQILTDVASDPTLPRTKAVRCAKCQHREAVFFQATTRSEDGMALFFVCCNRNCGHRWRD

SEQ ID NO: 350 - protein, 114 aa, A. thaliana
MSTMKFCRECNNILYPKEDKEQSILLYACRNCDHQEAADNNCVYRNEVHHSVSEQTQILSDVASDPTLPRTKAVRCAKCQHGEAVFFQATARGEEGMTLFFVCCNPNCSHRWRE

SEQ ID NO: 351 - protein, 114 aa, A. lyrata; identical to SEQ ID NO: 338

SEQ ID NO: 352 - protein, 114 aa, C. Melo; identical to SEQ ID NO: 339

SEQ ID NO: 353 - protein, 114 aa, V. Vinifera; identical to SEQ ID NO: 340

SEQ ID NO: 354 - protein, 114 aa, M. Truncatula; identical to SEQ ID NO: 341

SEQ ID NO: 355 - protein, 266 aa, R. Communis; identical to SEQ ID NO: 342

SEQ ID NO: 356 - protein, 114 aa, G. max; identical to SEQ ID NO: 343

SEQ ID NO: 357 - protein, 114 aa, Z. mays; identical to SEQ ID NO: 344

SEQ ID NO: 358 - protein, 114 aa, S. Bicolor; identical to SEQ ID NO: 345

SEQ ID NO: 359 - protein, 114 aa, O. Sativa; identical to SEQ ID NO: 346

SEQ ID NO: 360 - protein, 114 aa, B. Distachyon
MSAMKFCRECNNILYPKEEKDRRVLLFACRNCEHQEVSDNTCVYRNEVHHAATERTQVLQDVASDPTLPRTKSVRCTACGHGEAVYFQATARGEEGMTLFYVCCNLSCGNRWRE

SEQ ID NO: 361 - protein, 114 aa, P. trichocarpa; identical to SEQ ID NO: 348

SEQ ID NO: 362 - protein, 111 aa, B. Napus
MKFCRECNNILYPKEDKKQKILRYACRNCDYQEIADNYCVHRNEVHHSVSEKTQILTDVASDPTVPRTKDVRCAKCQHREAVFFQATTRSEDGMALFFVCCNRNCSHHWRD

SEQ ID NO: 363 - protein, 878 aa, Artificial Sequence
  Synthetic Construct
METSSSLPLSPISIEPEQPSHRDYDITTRRGVGTTGNPIELCTNHFNVSVRQPDVVFYQYTVSITTENGDAVDGTGISRKLMDQLFKTYSSDLDGKRLAYDGEKTLYTVGPLPQNEFDFLVIVEGSFSKRDCGVSDGGSSSGTCKRSKRSFLPRSYKVQIHYAAEIPLKTVLGTQRGAYTPDKSAQDALRVLDIVLRQQAAERGCLLVRQAFFHSDGHPMKVGGGVIGIRGLHSSFRPTHGGLSLNIDVSTTMILEPGPVIEFLKANQSVETPRQIDWIKAAKMLKHMRVKATHRNMEFKIIGLSSKPCNQQLFSMKIKDGEREVPIREITVYDYFKQTYTEPISSAYFPCLDVGKPDRPNYLPLEFCNLVSLQRYTKPLSGRQRVLLVESSRQKPLERIKTLNDAMHTYCYDKDPFLAGCGISIEKEMTQVEGRVLKPPMLKFGKNEDFQPCNGRWNFNNKMLLEPRAIKSWAIVNFSFPCDSSHISRELISCGMRKGIEIDRPFALVEEDPQYKKAGPVERVEKMIATMKLKFPDPPHFILCILPERKTSDIYGPWKKICLTEEGIHTQCICPIKISDQYLTNVLLKINSKLGGINSLLGIEYSYNIPLINKIPTLILGMDVSHGPPGRADVPSVAAVVGSKCWPLISRYRAAVRTQSPRLEMIDSLFQPIENTEKGDNGIMNELFVEFYRTSRARKPKQIIIFRDGVSESQFEQVLKIEVDQIIKAYQRLGESDVPKFTVIVAQKNHHTKLFQAKGPENVPAGTVVDTKIVHPTNYDFYMCAHAGKIGTSRPAHYHVLLDEIGFSPDDLQNLIHSLSYVNQRSTTATSIVAPVRYAHLAAAQVAQFTKFEGISEDGKVPELPRLHENVEGNMFFC

SEQ ID NO: 364 - protein, 896 aa, Artificial Sequence
  Synthetic Construct
MDSDEPNGSGLPPPPPFVPANLVPEVEPVKKNILLPMARPRGSGSKGQKIPLLTNHFGVKFNKPSGYFFHYSVAINYEDGRPVEAKGIGRKILDKVQETYQSDLGAKYFAYDGEKTLFTVGALPSNKLDFSVVLEEIPSSRNHAGNDTNDADRKRSRRPNQTKKFMVEISYAAKIPMQAIASALQGKETENLQDALRVLDIILRQSAARQGCLLVRQSFFHNDVKNFVPIGGGVSGCRGFHSSFRTTQGGLSLNIDTSTTMIVQPGPVVDFLLANQNKKDPYGMDWNKARRVLKNLRVQITLSNREYKISGLSEHSCKDQLFTWRKPNDKGEFEEVEITVLNYYKERNIEVRYSGDFPCINVGKPKRPTYFPIEFCNLVSLQRYTKSLTNFQRAALVEKSRQKPPERMASLTKGLKDSNYNADPVLQDSGVSIITNFTQVEGRILPTPMLKVGKGENLSPIKGKWNFMRKTLAEPTTVTRWAVVNFSARCDTNTLIRDLIKCGREKGINVEPPFKDVINENPQFRNAPATVRVENMFEQIKSKLPKPPLFLLCILAERKNSDVYGPWKKKNLVDLGIVTQCIAPTRLNDQYLTNVLLKINAKLGGLNSLLAMERSPAMPKVTQVPTIIVGMDVSHGSPGQSDIPSIAAVVSSRQWPLISKYKACVRTQSRKMEMIDNLFKPVNGKDEGMFRELLLDFYYSSENRKPEHIIIFRDGVSESQFNQVLNIELDQMMQACKFLDDTWHPKFTVIVAQKNHHTKFFQSRGPDNVPPGTIIDSQICHPRNFDFYLCAHAGMIGTTRPTHYHVLYDEIGFATDDLQELVHSLSYVYQRSTTAISVVAPVCYAHLAAAQMGTVMKYEELSETSSSHGGITTPGAVPVPPMPQLHNNVSTSMFFC

SEQ ID NO: 365 - protein, 501 aa, Artificial Sequence
  Synthetic Construct
MDTGGNSLASGPDGVKRKVCYFYDPEVGNYYYGQGHPMKPHRIRMTHALLAHYGLLQHMQVLKPFPARDRDLCRFHADDYVSFLRSITPETQQDQIRQLKRFNVGEDCPVFDGLYSFCQTYAGGSVGGSVKLNHGLCDIAINWAGGLHHAKKCEASGFCYVNDIVLAILELLKQHERVLYVDIDIHHGDGVEEAFYATDRVMTVSFHKFGDYFPGTGHIQDIGYGSGKYYSLNVPLDDGIDDESYHLLFKPIMGKVMEIFRPGAVVLQCGADSLSGDRLGCFNLSIKGHAECVKFMRSFNVPLLLLGGGGYTIRNVARCWCYETGVALGVEVEDKMPEHEYYEYFGPDYTLHVAPSNMENKNSRQMLEEIRNDLLHNLSKLQHAPSVPFQERPPDTETPEVDEDQEDGDKRWDPDSDMDVDDDRKPIPSRVKREAVEPDTKDKDGLKGIMERGKGCEVEVDESGSTKVTGVNPVGVEEASVKMEEEGTNKGGAEQAFPPKT

SEQ ID NO: 366 - protein, 409 aa, Artificial Sequence
  Synthetic Construct
MASLADGGKRRVSYFYEPMIGDYYYGVNQPTKPQRIRVTHNLILSYNLHRHMEINHPDLADASDFEKFHSLEYINFLKSVTPETVTDPHPSVSENLKRFNVDVDWDGPVFHNLFDYCRAYAGGSISAAAKLNRQEADIAINWAGGMHHVKKDKASGFGYVNDVVLAILELLKSFKRVLYIEIGFPHGDEVEEAFKDTDRVMTVSFHKVGDTGDISDYGEGKGQYYSLNAPLKDGLDDFSLRGLFIPVIHRAMEIYEPEVIVLQCGADSLAGDPFGTFNLSIKGHGDCLQYVRSFNVPLMILGGGGYTLPNVARCWCYETAIAVGEQLDNDLPGNDYMKYFRPDYKLHILPTNRQNLNTRLDIITMRETLLAQLSLVMHAPSVPFQDTPSSSQATEAAEVDMEKRNDPRI

SEQ ID NO: 367 - protein, 426 aa, Artificial Sequence
  Synthetic Construct
MRSKDKISYFYDGDVGSVYFGPNHPMKPHRLCMTHHLILAYGLHSKMEVYRPHKAYPIEMAQFHSPDYVEFLQRINPENQNLFPNEMARYNLGEDCPVFEDLFEFCQLYAGGTIDAARRLNNKLCDIAINWAGGLHHAKKCDASGFCYINDLVLGILELLKHHPRVLYIDIDVHHGDGVEEAFYFTDRVMTVSFHKFGDKFFPGTGDVKEIGEREGKFYAINVPLKDGIDDSSFNRLFRTIISKVVEIYQPGAIVLQCGADSLARDRLGCFNLSIDGHAECVKFVKKFNLPLLVTGGGGYTKENVARCWTVETGILLDTELPNEIPENDYIKYFAPDFSLKIPGGHIENLNTKSYISSIKVQILENLRYIQHAPSVQMQEVPPDFYIPDFDEDEQNPDVRADQRSRDKQIQRDDEYFDGDNDNDAS

SEQ ID NO: 368 - skipped

SEQ ID NO: 369 - protein, 501 aa, Artificial Sequence
  Synthetic Construct
MVVETIERSCEGSKRRHVNGGDIAVPCSGEECSNGDINVAPGVSAKRARVSREMTFEDIYGADALLNDDDDEDDDCDWEPVQAPMEFVKWCCVNCTMSNPGDMVHCCICGEHKESGILRHGYLASPFFKDTGLIEVEEKYGGSSSATSSTAVGFDERMLLHSEFEVKAQPHPERPDRLRAIAASLATAGVFPGRCLPINAREITKQELQMVHTSEHVDAVDTTSQLLYSYFTSDTYANEYSARAARLAAGLCADLATDIFTGRVKNGFALVRPPGHHAGVRHAMGFCLHNNAAVAALVAQAAGAKKVLIVDWDVHHGNGTQEIFEQNKSVLYISLHRHEGGNFYPGTGAADEVGSNGGEGYCVNVPWSCGGVGDKDYIFAFQHVVLPIASAFSPDFVIISAGFDAARGDPLGCCDVTPAGYSRMTQMLGDLCGGKMLVILEGGYNLRSISASATAVIKVLLGENPENELPIATTPSVAGLQTVLDVLNIQLEFWPSLAISY

SEQ ID NO: 370 - protein, 423 aa, Artificial Sequence
  Synthetic Construct
MSMALIVRPFFVPGSAGISGSRNICKKNQWRKYLLKPSGSSINCSFSTEKNPLLPSIQQLADARLIYSVSAALGHNKESHPECSARVPAIVNALEMNELTPKFRGSQILELANFKTATVEDIANVHDKAYVFGLEKAMDEASDSGLIFIEGSGPTYATSTTFQDSLIAAGAGMALVDSVIAASRNSVDPPIGFALIRPPGHHAVPKGPMGFCVFGNVAIAARHAQRTHGLKRIFIIDFDVHHGNGTNDAFTEDPDIFFLSTHQDGSYPGTGKISDIGKGKGEGTTLNLPLPGGSGDIAMRTVFEEIIVPCAQRFKPDIILVSAGYDAHVLDPLANLQFTTATYYSLAKDIKRLAKEVCGGRCVFFLEGGYNLESLSSSVADSFRALLGEDSLASEFDNPAYLYDEPMRKVRDAIQRAKSIHCL

SEQ ID NO: 371 - protein, 16 aa, Artificial Sequence
  Synthetic Construct
DKKNSETESGPAAWGS

SEQ ID NO: 372 - protein, 95 aa, Artificial Sequence
  Synthetic Construct
MLRSSDKKNSETESGPAAWGSSDKKNSETESGPAAWGSSDKKNSETESGPAAWGSSDKKNSETESGPAAWGSSDKKNSETESGPAAWGSPGLQTC

SEQ ID NO: 373 - protein, 791 aa, Artificial Sequence
  Synthetic Construct
MAARNKQKKRAEPESDLCFAGKPMSVVESTIRWPHRYQSKKTKLQAPTKKPANKGGKKEDEEIIKQAKCHFDKALVDGVLINLNDDVYVTGLPGKLKFIAKVIELFEADDGVPYCRFRWYYRPEDTLIERFSHLVQPKRVFLSNDENDNPLTCIWSKVNIAKVPLPKITSRIEQRVIPPCDYYYDMKYEVPYLNFTSADDGSDASSSLSSDSALNCFENLHKDEKFLLDLYSGCGAMSTGFCMGASISGVKLITKWSVDINKFACDSLKLNHPETEVRNEAAEDFLALLKEWKRLCEKFSLVSSTEPVESISELEDEEVEENDDIDEASTGAELEPGEFEVEKFLGIMFGDPQGTGEKTLQLMVRWKGYNSSYDTWEPYSGLGNCKEKLKEYVIDGFKSHLLPLPGTVYTVCGGPPCQGISGYNRYRNNEAPLEDQKNQQLLVFLDIIDFLKPNYVLMENVVDLLRFSKGFLARHAVASFVAMNYQTRLGMMAAGSYGLPQLRNRVFLWAAQPSEKLPPYPLPTHEVAKKFNTPKEFKDLQVGRIQMEFLKLDNALTLADAISDLPPVTNYVANDVMDYNDAAPKTEFENFISLKRSETLLPAFGGDPTRRLFDHQPLVLGDDDLERVSYIPKQKGANYRDMPGVLVHNNKAEINPRFRAKLKSGKNVVPAYAISFIKGKSKKPFGRLWGDEIVNTVVTRAEPHNQCVIHPMQNRVLSVRENARLQGFPDCYKLCGTIKEKYIQVGNAVAVPVGVALGYAFGMASQGLTDDEPVIKLPFKYPECMQAKDQI

SEQ ID NO: 374 - protein, 1295 aa, Artificial Sequence
  Synthetic Construct
MLSPAKCESEEAQAPLDLHSSSRSEPECLSLVLWCPNPEEAAPSSTRELIKLPDNGEMSLRRSTTLNCNSPEENGGEGRVSQRKSSRGKSQPLLMLTNGCQLRRSPRFRALHANFDNVCSVPVTKGGVSQRKFSRGKSQPLLTLTNGCQLRRSPRFRAVDGNFDSVCSVPVTGKFGSRKRKSNSALDKKESSDSEGLTFKDIAVIAKSLEMEIISECQYKNNVAEGRSRLQDPAKRKVDSDTLLYSSINSSKQSLGSNKRMRRSQRFMKGTENEGEENLGKSKGKGMSLASCSFRRSTRLSGTVETGNTETLNRRKDCGPALCGAEQVRGTERLVQISKKDHCCEAMKKCEGDGLVSSKQELLVFPSGCIKKTVNGCRDRTLGKPRSSGLNTDDIHTSSLKISKNDTSNGLTMTTALVEQDAMESLLQGKTSACGAADKGKTREMHVNSTVIYLSDSDEPSSIEYLNGDNLTQVESGSALSSGGNEGIVSLDLNNPTKSTKRKGKRVTRTAVQEQNKRSICFFIGEPLSCEEAQERWRWRYELKERKSKSRGQQSEDDEDKIVANVECHYSQAKVDGHTFSLGDFAYIKGEEEETHVGQIVEFFKTTDGESYFRVQWFYRATDTIMERQATNHDKRRLFYSTVMNDNPVDCLISKVTVLQVSPRVGLKPNSIKSDYYFDMEYCVEYSTFQTLRNPKTSENKLECCADVVPTESTESILKKKSFSGELPVLDLYSGCGGMSTGLSLGAKISGVDVVTKWAVDQNTAACKSLKLNHPNTQVRNDAAGDFLQLLKEWDKLCKRYVFNNDQRTDTLRSVNSTKETSGSSSSSDDDSDSEEYEVEKLVDICFGDHDKTGKNGLKFKVHWKGYRSDEDTWELAEELSNCQDAIREFVTSGFKSKILPLPGRVGVICGGPPCQGISGYNRHRNVDSPLNDERNQQIIVFMDIVEYLKPSYVLMENVVDILRMDKGSLGRYALSRLVNMRYQARLGIMTAGCYGLSQFRSRVFMWGAVPNKNLPPFPLPTHDVIVRYGLPLEFERNVVAYAEGQPRKLEKALVLKDAISDLPHVSNDEDREKLPYESLPKTDFQRYIRSTKRDLTGSAIDNCNKRTMLLHDHRPFHINEDDYARVCQIPKRKGANFRDLPGLIVRNNTVCRDPSMEPVILPSGKPLVPGYVFTFQQGKSKRPFARLWWDETVPTVLTVPTCHSQALLHPEQDRVLTIRESARLQGFPDYFQFCGTIKERYCQIGNAVAVSVSRALGYSLGMAFRGLARDEHLIKLPQNFSHSTYPQLQETIPH

SEQ ID NO: 375 - protein, 624 aa, Artificial Sequence
  Synthetic Construct
MAGKRKRANAPDQTERRSSVRVQKVRQKALDEKARLVQERVKLLSDRKSEICVDDTELHEKEEENVDGSPKRRSPPKLTAMQKGKQKLSVSLNGKDVNLEPHLKVTKCLRLFNKQYLLCVQAKLSRPDLKGVTEMIKAKAILYPRKIIGDLPGIDVGHRFFSRAEMCAVGFHNHWLNGIDYMSMEYEKEYSNYKLPLAVSIVMSGQYEDDLDNADTVTYTGQGGHNLTGNKRQIKDQLLERGNLALKHCCEYNVPVRVTRGHNCKSSYTKRVYTYDGLYKVEKFWAQKGVSGFTVYKYRLKRLEGQPELTTDQVNFVAGRIPTSTSEIEGLVCEDISGGLEFKGIPATNRVDDSPVSPTSGFTYIKSLIIEPNVIIPKSSTGCNCRGSCTDSKKCACAKLNGGNFPYVDLNDGRLIESRDVVFECGPHCGCGPKCVNRTSQKRLRFNLEVFRSAKKGWAVRSWEYIPAGSPVCEYIGVVRRTADVDTISDNEYIFEIDCQQTMQGLGGRQRRLRDVAVPMNNGVSQSSEDENAPEFCIDAGSTGNFARFINHSCEPNLFVQCVLSSHQDIRLARVVLFAADNISPMQELTYDYGYALDSVHGPDGKVKQLACYCGALNCRKRLY

SEQ ID NO: 376 - protein, 819 aa, Artificial Sequence [sequence omitted]

SEQ ID NO: 377 - protein, 806 aa, Artificial Sequence [sequence omitted]

SEQ ID NO: 378 - protein, 1209 aa, Artificial Sequence
  Synthetic Construct
MGTELMRICVKEDSDDLPSVPPGFESYATFTLKRVVPATTSDKAKTPAIESVSATEQAKMEVESDEAKAARALRRRPWINHSGCDDDGDCAANNDNAASQNPDQNCDVKPALPKGVVRGCEECKDCQKVTARWHPDEARRPDLEDAPVFYPSEEEFEDTLNYIAKIRPEAEKYGICRIVPPPSWKPPCPLKEKQVWEGSKFTTRVQRVDKLQNRSSMKKISKLPNQMRKKKRKCMKMGMDSVTNGMGDPCSASTGMNELETFGFEPGPGFTLKDFQKYADEFKAQYFKKSETSTDDKCKVDNSIDCWEPALEDVEGEYWRIVDKATEEIEVLYGADLETGVFGSGFPKISSSHNASSSEDKYAKSGWNLNNFPRLPGSLLKYEGSDISGVLVPWLYIGMCFSSFCWHVEDHHLYSLNYMHWGAPKLWYGVGGKDAVKLEEAMRKHLPDLFEEQPDLLHKLVTQLSPSKLKTAGVPVHRCVQHAGEFVLTFPRAYHAGFNSGFNCAEAVNVAPVDWLPHGQIAIELYCQQGRKTSISHDKLLLGAAREVVKADWELNLLRKNTVDNLRWKAFSAKDGILAKTLKARIDMERTRREFLCNSSLALKMHSNFDATNERECCICFFDLHLSAAGCRCSPEKYSCLTHVKELCSCPWVTKYFLFRYDIDELNVLVEAVEGKLSSVYRWARQDLGLALSTDVSGSKMEIDEEGKVHKDPTPQTTALSGKDLQLKVTSKEVSKELEKTSKLSHVNLLLKEKEEQITSSHCMKPVKEETVCDSSDPNVSACQPSEGGIICMTAVKSASGKKNSQSLPNDVILLSDDEYDIPRKRGSVRRDAISSGKKLEIRERPTHVLALEASAKIAAPICQREGDSLRDTRNTISLPTNDQKTMRRDVPSSTSHAEVNAEATGLTQDICNRMATNSHGGGKPTSCKSKNSGGLAIVDVVDGTRSSSGTPSCSQNNSPDRFIRQKGPRIAKVVRRINCNVEPLSYGCVLSGKSWCSRRAIFPKGFRSRVKYINILDPTNMCFYISEILDAGRNSPLFMVYLESNPSEVFVHMSPTRCWEMVRERVNQEITKQHKAGKSDLPPLQPSGSPDGFEMFGYSSPAIVQAIEALDVNRVCTDYWDSRPYSRPQVQFPANPLLREANTSGRSNVGNLQLNPGHHISPTGINSILKVLFKKASMEELSSLQEVLSETNSDMVTELVKEEIQNRR

SEQ ID NO: 379 - protein, 1410 aa, Artificial Sequence
  Synthetic Construct
MECIGKRVKSRSWQRLQAVNKRKKMETVAPVTSPPKKRRQKKPKNYDSDIEDITPTCNDSVPPPQVSNMYSVPNNSVKESFSRIMRDLNVEKKSGPSSSRLTDGSEQNPCLKERSFRVSDLGVEKKCSPEITDLDVGIPVPRFSKLKDVSEQKNTCLMQKSSPEIADLDLVISVPSSSVLKDVSEEIRFLKDKCSPEIRGLVLEKSVPGEIEILSDSESETEARRRASAKKKLFEESSRIVESISDGEDSSSETDEEEEENQDSEDNNTKDNVTVESLSSEDPSSSSSSSSSSSSSSSSSSSDDESYVKEVVGDNRDDDDLRKASSPIKRVSLVERKALVRYKRSGSSLTKPRERDNKIQKLNHREEEKKERQREVVRVVTKQPSNVVYTCAHCGKENTGNPESHSSFIRPHSIRDEIEDVNNFASTNVSKYEDSVSINSGKTTGAPSRPEVENPETGKELNTPEKPSISRPEIFTTEKAIDVQVPEEPSRPEIYSSEKAKEVQAPEMPSRPEVFSSEKAKEIQVPEMPSIPEIQNSEKAKEVQANNRMGLTTPAVAEGLNKSVVTNEHIEDDSDSSISSGDGYESDPTLKDKEVKINNHSDWRILNGNNKEVDLFRLLVNSVWEKGQLGEEDEADELVSSAEDQSQEQAREDHRKYDDAGLLIIRPPPLIEKFGVEEPQSPPVVSEIDSEEDRLWEELAFFTKSNDIGGNELFSNVEKNISANETPAAQCKKGKHDLCIDLEVGLKCMHCGFVEREIRSMDVSEWGEKTTRERRKFDRFEEEEGSSFIGKLGFDAPNNSLNEGCVSSEGTVWDKIPGVKSQMYPHQQEGFEFIWKNLAGTIMLNELKDFENSDETGGCIMSHAPGTGKTRLTIIFLQAYLQCFPDCKPVIIAPASLLLTWAEEFKKWNISIPFHNLSSLDFTGKENSAALGLLMQKNATARSNNEIRMVKIYSWIKSKSILGISYNLYEKLAGVKDEDKKTKMVREVKPDKELDDIREILMGRPGLLVLDEAHTPRNQRSCIWKTLSKVETQKRILLSGTPFQNNFLELCNVLGLARPKYLERLTSTLKKSGMTVTKRGKKNLGNEINNRGIEELKAVMLPFVHVHKGSILQSSLPGLRECVVVLNPPELQRRVLESIEVTHNRKTKNVFETEHKLSLVSVHPSLVSRCKISEKERLSIDEALLAQLKKVRLDPNQSVKTRFLMEFVELCEVIKEKVLVFSQYIDPLKLIMKHLVSRFKWNPGEEVLYMHGKLEQKQRQTLINEFNDPKSKAKVFLASTKACSEGISLVGASRVILLDVVWNPAVERQAISRAYRIGQKRIVYTYHLVAKGTPEGPKYCKQAQKDRISELVFACSSRHDKGKEKIAEAVTEDKVLDTMVEHSKLGDMFDNLIVQPKEADLVEGFSILMP

SEQ ID NO: 380 - protein, 1261 aa, Artificial Sequence
  Synthetic Construct
MKKRGFYNLKHPFDPCPFEFFCSGTWKPVEYMRIEDGMMTIRLLENGYVLEDIRPFQRLRLRSRKAALSDCICFLRPDIDVCVLYRIHEDDLEPVWVDARIVSIERKPHESECSCKINVRIYIDQGCIGSEKQRINRDSVVIGLNQISILQKFYKEQSTDQFYRWRFSEDCTSLMKTRLSLGKFLPDLSWLTVTSTLKSIVFQIRTVQTKMVYQIVTDEEGSSSTLSSMNITLEDGVSLSKVVKFNPADILDDSQDLEIKQETDYYQEEDEVVELRRSKRRNVRPDIYTGCDYEPDTIDGWVRMMPYQFGKCAVNVESDEDEDDNNEDGDTNDDLYIPLSRLFIKKKKTNSREAKPKSRKGEIVVIDKRRVHGFGRKERKSELSVIPFTPVFEPIPLEQFGLNANSFGGGGSFSRSQYFDETEKYRSKGMKYGKKMTEMEEMMEADLCWKGPNQVKSFQKRTSRSSRSVAPKTEDSDEPRVYKKVTLSAGAYNKLIDTYMNNIESTIAAKDEPTSVVDQWEELKKTNFAFKLHGDMEKNLSEDGEGETSENEMLWREMELCLASSYILDDNEVRVDNEAFEKARSGCEHDYRLEEEIGMCCRLCGHVGSEIKDVSAPFAEHKKWTIETKHIEEDDIKTKLSHKEAQTKDFSMISDSSEMLAAEESDNVWALIPKLKRKLHVHQRRAFEFLWRNVAGSVEPSLMDPTSGNIGGCVISHSPGAGKTFLIIAFLTSYLKLFPGKRPLVLAPKTTLYTWYKEFIKWEIPVPVHLIHGRRTYCTFKQNKTVQFNGVPKPSRDVMHVLDCLEKIQKWHAHPSVLVMGYTSFTTLMREDSKFAHRKYMAKVLRESPGLLVLDEGHNPRSTKSRLRKALMKVGTDLRILLSGTLFQNNFCEYFNTLCLARPKFIHEVLMELDQKFKTNHGVNKAPHLLENRARKLFLDIIAKKIDASVGDERLQGLNMLKNMTNGFIDNYEGSGSGSGDALPGLQIYTLVMNSTDIQHKILTKLQDVIKTYFGYPLEVELQITLAAIHPWLVTSSNCCTKFFNPQELSEIGKLKHDAKKGSKVMFVLNLIFRVVKREKILIFCHNIAPIRMFTELFENIFRWQRGREILTLTGDLELFERGRVIDKFEEPGNPSRVLLASITACAEGISLTAASRVIMLDSEWNPSKTKQAIARAFRPGQQKVVYVYQLLSRGTLEEDKYRRTTWKEWVSCMIFSEEFVADPSLWQAEKIEDDILREIVGEDKVKSFHMIMKNEKASTG

SEQ ID NO: 381 - protein, 1132 aa, Artificial Sequence
  Synthetic Construct
MDMTSCVARRTRSRTESYLNSILNKSKGISGEEEDQSLGCVNSRTEKRRVNMRDACSPSPRKKKRRRRKDDDDDVVFVRTEYPEGKRDDENVGSTSGNLQSKSFDFGDRVCDFDADDRNLGCEEKASNFNPIDDDDDVVFVGTVQRENDHVEDDDNVGSASVISPRVCDFDEDDAKVSGKENPLSPDDDDDVVFLGTIAGENQHVEDVNAGSEVCDILLDDANLRGEEKTYVSDEVVSLSSSSDDEEDPLEELGTDSREEVSGEDRDSGESDMDEDANDSDSSDYVGESSDSSDVESSDSDFVCSEDEEGGTRDDATCEKNPSEKVYHHKKSRTFRRKHNFDVINLLAKSMLESKDVFKEDIFSWDKIAEVDSREDPVVRESSSEKVNEHGKPRERRSFHRVREKNHLNGESFYGGEKLCDGEETINYSTEDSPPLNLRFGCEEPVLIEKTEEEKELDSLWEDMNVALTLEGMHSSTPDKNGDMLCSKGTHDFVLDDEIGLKCVHCAYVAVEIKDISPAMDKYRPSVNDNKKCSDRKGDPLPNRLEFDASDPSSFVAPLDNIEGTVWQYVPGIKDTLYPHQQEGFEFIWKNLAGTTKINELNSVGVKGSGGCIISHKAGTGKTRLTVVFLQSYLKRFPNSHPMVIAPATLMRTWEDEVRKWNVNIPFYNMNSLQLSGYEDAEAVSRLEGNRHHNSIRMVKLVSWWKQKSILGISYPLYEKLAANKNTEGMQVFRRMLVELPGLLVLDEGHTPRNQSSLIWKVLTEVRTEKRIFLSGTLFQNNFKELSNVLCLARPADKDTISSRIHELSKCSQEGEHGRVNEENRIVDLKAMIAHFVHVHEGTILQESLPGLRDCVVVLNPPFQQKKILDRIDTSQNTFEFEHKLSAVSVHPSLYLCCNPTKKEDLVIGPATLGTLKRLRLKYEEGVKTKFLIDFIRISGTVKEKVLVYSQYIDTLKLIMEQLIAECDWTEGEQILLMHGKVEQRDRQHMIDNFNKPDSGSKVLLASTKACSEGISLVGASRVVILDVVWNPSVESQAISRAFRIGQKRAVFIYHLMVKDTSEWNKYCKQSEKHRISELVFSSTNEKDKPINNEVVSKDRILDEMVRHEKLKHIFEKILYHPKKSDMNTSFF

SEQ ID NO: 382 - protein, 638 aa, Artificial Sequence
  Synthetic Construct
MNNKLSDFEKNLYKKLKSGKLEVKVSYRTFLCPYCPDNKKKVGLYVDILQHASGVGNSQSKKRSLTEKASHRALAKYLIKDLAHYATSTISKRLKARTSFIPAETGDAPIIYDDAQFEKLVWPWKGVLVNIPTTSTEDGRSCTGESGPKLKDELIRRGFNPIRVRTVWDRFGHSGTGIVEFNRDWNGLQDALVFKKAYEGDGHGKKDWLCGATDSSLYAWLANADDYYRANILGENLRKMGDLKSIYRFAEEEARKDQKLLQRLNFMVENKQYRLKKLQIKYSQDSVKLKYETEEKEKILRAYSEDLTGRQQKSTDHFNRIFADHEKQKVQLESQIKELEIRKLELAKREAENETQRKIVAKELEQNAAINSYVQLSALEQQKTREKAQRLAVDHKMQKEKLHKRIAALERQLDQKQELELEVQQLKSQLSVMRLVELDSGSEIVNKVETFLRDLSETEGELAHLNQFNQDLVVQERKSNDELQEARRALISNLRDMGLHIGVKRMGELDTKPFMKAMRIKYCQEDLEDWAVEVIQLWEEYLKDPDWHPFKRIKLETAETIVEVIDEDDEKLRTLKNELGDDAYQAVANALLEINEYNPSGRYISSELWNFREDRKATLEEGVNSLLEQWNQAKHLKS

SEQ ID NO: 383 - protein, 472 aa, Artificial Sequence
  Synthetic Construct
MGGTRHCYGLGYEMFNFVWSSSVRFVWSSSETLFKIVIITRSLCILGKVHTLLTFKVLTFLLKIELQCVFSDCVYVAETGIVVNIPTTKAQDGRPAGESGSKLRDEYILRGLNNGLLFDKAYRVDGHGKKDWMKKDGPKLGLYGWIAGADDYNDRELKTIAELTKEEARKQQMLVKNLRQVVEEKIKDVKEIEELFDDHERLTKLLESEKKKLEIKGNELAKPQVHNGTERMKLSEDLEQRQKEELHEKIIRLERQIDQVQAIELEVEQLKGQLNVMKHMASDGDAQVVKEVDIIFKDLVEKEAELADLNKFNQTLILRERRTNDELQEARKELVNCMGELVRKPFVDAMQQKYCQEDVEDRAVEVLQLWEHYINDPDWHPYKRVKLENQDREVEVIDDRDEKLRELKADLGDGPYNAVTKALLEINEYNPSGRYITTELWNFKEDKRATLEEGVTCLLDQWEKAKRKRGMA

SEQ ID NO: 384 - protein, 736 aa, Artificial Sequence
  Synthetic Construct
MYSRRELEDLEYRYYSEMKDGTRKVKISESLFRCPFCYIDRKRDYQFDDLLRHASGIGGSSRTKDGRDKARHLALERYMRKYLRPRERPRPSPTSDVSSLPKEEFTGKWKSTLSTTEEGEFITTENSSSPHIVKAEPKFVSGDDSGRSGEERLKFSDKPDPFFSNEDKSYPAKRPCLVSGAKEGDEPVQRIGLSHGASFAPTYPQKLVSLGAGNGDQMYVHPWKGILANMKRTFNEKTRKYAGESGSKIREDLIKKGFNPHKVTPLWNGRLGFTGFAIVDFGKEWEGFRNATMFDKHFEVSQCGKRDHDLTRDPGDKLYGWVAKQDDYYSRTAIGDHLRKQGDLKSVSGKEAEDQRKTFTLVSNLENTLVTKSDNLQQMESIYKQTSSVLEKRMKEKDEMINTHNEKMSIMQQTARDYLASIYEEHEKASQHLEAQRKEYEDRENYLDKCQAKNKTERRKLQWQKHKNLMATQEQNKADEDMMRLAEQQQREKDELRKQVRELEEKIDAEQALELEIERMRGDLQVMGHMQEGEGEDSKIKEMIEKTKEELKEKEEDWEYQESLYQTLVVKHGYTNDELQDARKALIRSMRELTTRAYIGVKRMGALDETPFKKVAKEKYPAVEADKKAEELCSLWEEHLGDSAWHPIKVVEKDGIAKEELNEEDEKLQELRKELGEEVYAAVTQALKERNEYNGSGRYIVPELWNFKQNRKASIKEGVVYLVNSWKQKKPKPKRR

SEQ ID NO: 385 - protein, 634 aa, Artificial Sequence
  Synthetic Construct
MDNSSDEESEISESEIDVYYEKPYEKLMNGDYKVKVKDTFRCPFCAGKKKQHYKYKELLAHASGVAKGSASRSAKQKANHFALAKYMENELAGDADVPRPQIPSSSTEQSQAVVDDIYVWPWMGIVINPVRRTDNKNVLLDSAYWLKKLARFNPLEVKTLWLDQESVVAVIPQFNSGWSGFKSVTELEKEYEIRGCGRKDWIDKRGDWRSKAYGWCARADDYNSQGSIAEYLSKVGKLRSFSDITKEEIQNKSIVVDDLANKIAMTNEDLNKLQYMNNEKTLSLRRVLIEKDELDRVYKQETKKMQELSREKINRIFREKERLTNELEAKMNNLKIWSKQLDKKQALTELERQKLDEDKKKSDVMNSSLQLASLEQKKTDDRVLRLVDEHKRKKEETLNKILQLEKELDSKQKLQMEIQELKGKLKVMKHEDEDDEGIKKKMKKMKEELEEKCSELQDLEDTNSALMVKERKSNDEIVEARKFLITELRELVSDRNIIRVKRMGELEEKPFMTACRQRCTVEEEAQVQYAMLCSKWQEKVKDSAWQPFKHVGTGDRKKEVVDEEDEEIKKLREEWGEEVKNAVKTALEELNEFNPSGRYSVPELWNSKQGRKATLKEVIDYITQQVKTLKRRRA

SEQ ID NO: 386 - protein, 634 aa, Artificial Sequence
  Synthetic Construct
MSISDEEAEISESEIEDYSETPYRLLRDGTYKVKVNGQLRCPFCAGKKKQDYKYKELYAHATGVSKGSATRSALQKANHLALAMFLENELAGYAEPVPRPPVVPPQLDETEPNPHNVYVWPWMGIVVNPLKEADDKELLLDSAYWLQTLSKFKPIEVNAFWVEQDSIVGVIAKFNGDWSGFAGATELEKEFETQGSSKKEWTERSGDSESKAYGWCARADDFESQGPIGEYLSKEGQLRTVSDISQKNVQDRNTVLEELSDMIAMTNEDLNKVQYSYNRTAMSLQRVLDEKKNLHQAFADETKKMQQMSLRHIQKILYDKEKLSNELDRKMRDLESRAKQLEKHEALTELDRQKLDEDKRKSDAMNKSLQLASREQKKADESVLRLVEEHQRQKEDALNKILLLEKQLDTKQTLEMEIQELKGKLQVMKHLGDDDDEAVQKKMKEMNDELDDKKAELEGLESMNSVLMTKERQSNDEIQAARKKLIAGLTGLLGAETDIGVKRMGELDEKPFLDVCKLRYSANEAAVEAATLCSTWQENLKNPSWQPFKHEGTGDGAEEVVDEDDEQLKKLKREWGKEVHNAVKTALVEMNEYNASGRYTTPELWNFKEGRKATLKEVITFISNDIKILKRKRT

SEQ ID NO: 387 - protein, 635 aa, Artificial Sequence
  Synthetic Construct
MDISDEESEISESEIEEYSKTPYHLLRSETYYKVKVNGRLRCPFCVGKKKQDYKYKELHAHATGVSKGSATRSALQKSNHLALAKFLENDLAGYAEPLPRPPVVPPLLDETEPNPHNVYVWPWMGIVVNPLKETDDKELLLDSVYWLQTLSKFKPVEVNAFWVEQDSIVGVIAKFDSDWSGFAAATELEKEFETQGSCKKEWTERSGDSESKAYGWCARADDFQSQGPIGEYLSKEGTLRTVSDILQNNVQDRNTLLDVLSNMIDMTNEDLNKAQHSYNRTAMSLQRVLDEKKNLHQAFAEETKKMQQMSLRHIQRILYDKEKLRNELDRKMRDLESRAKQLEKHEALTELERQKLDEDKRKSDAMNKSLQLASREQKKADESVLRLVEEHQRQKEDALNKILLLEKQLDTKQTLEMEIQELKGKLQVMKHLGDDDDEAVQTKMKEMNDELDDKKAELEDLESMNSVLMTKERQSNDEIQAARQKMIAGLTGLLGAESDIGVKRMGELDEKPFLDVCKLRYSANEARVEAATLCSTWKENLKNPSWQPFKREGTGDGAEEVVDEDDEQLKKLKREWGKEVHNAVKAALVEMNEYNASGRYPTSELWNFKEGRKATLKEVITFISTDIKNLKRKRT

SEQ ID NO: 388 - protein, 561 aa, Artificial Sequence
  Synthetic Construct
MEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 389 - protein, 1107 aa, Artificial Sequence
  Synthetic Construct
MGKTIQVFGFPNGVSAEEVKKFLERLTGSGTVYAIKVRQPKKGGPRVYAIVQFTSERHTRLIITAAAERLYYGRSYLKAFEVEQDIVPKPRASLHTISGLKMFFGCQVSTKKFLTLWSAQDVCVSFGIGMRKLHFSFSWYQKDYRLELSYENIWQIDLHSPQGRSSKFLVIQVIGAPKIFEKEDQPINLLFGIMDFYSDGSDEQWIRTTDFTSSSCIGQSTAFCLELPVHLNVPDFRENFANYAEHRASSFLIESGSSYSSNANTLVPVVDPPPGFSLPFEILFKLNTLVQNACLSGPALDLDFYRLLNQKKYDRALIDHCLEKLFHLGECCYEPAHWLRDEYKKWISKGKLPLSPTISLDDGLVYMYRVQVTPARVYFSGPEVNVSNRVLRHYSKYINNFLRVSFVDEDLEKVRSMDLSPRSSTQRRTKLYDRIYSVLRDGIVIGDKKFEFLAFSSSQLRENSAWMFAPIDRITAAHIRAWMGDFDHIRNVAKYAARLGQSFSSSRETLNVRSDEIEVIPDVEIISLGTRYVFSDGIGKISAEFARKVARKCGLTEFSPSAFQIRYGGYKGVVAVDPNSSKKLSLRKSMSKFESENTKLDVLAWSKYQPCYMNRQLITLLSTLGVTDSVFEKKQREVVDRLDAILTHPLEAHEALGLMAPGENTNILKALILCGYKPDAEPFLSMMLQNFRASKLLELRTKTRIFISGGRSMMGCLDETRTLEYGQVVVQYSDPMRPGRRFIITGPVVVAKNPCLHPGDVRVLQAVNVPALNHMVDCVVFPQKGLRPHPNECSGSDLDGDIYFVCWDQELVPPRTSEPMDYTPEPTQILDHDVTIEEVEEYFANYIVNDSLGIIANAHTAFADKEPLKAFSDPCIELAKKFSTAVDFPKTGVAAVIPQHLYVKEYPDFMEKPDKPTYESKNVIGKLFREVKERAPPLISIKSFTLDVASKSYDKDMEVDGFEEYVDEAFYQKANYDFKLGNLMDYYGIKTEAEILSGGIMRMSKSFTKRRDAESIGRAVRALRKETLSLFNASEEEENESAKASAWYHVTYHSSYWGLYNEGLNRDHFLSFAWCVYDKLVRIKKTNLGRRQRQETLERLDHVLRFG

SEQ ID NO: 390 - skipped

SEQ ID NO: 391 - protein, 1580 aa, Artificial Sequence
  Synthetic Construct
MHSSLEPEKMEEGGGSNSLKRKFSEIDGDQNLDSVSSPMMTDSNGSYELKVYEVAKNRNIIAVLGTGIDKSEITKRLIKAMGSSDTDKRLIIFLAPTVNLVKQQCCEIRALVNLKVEEYFGAKGVDKWTSQRWDEEFSKHDVLVMTPQILLDVLRSAFLKLEMVCLLIIDECHHTTGNHPYAKLMKEFYHESTSKPKIFGLTASAVIRKGIVSSPSNYAAQVSELERLMDSKIFNPEEREGVEKFATTVKEGPILYNPSPSCSLELKEKLETSHLKFDASLRRLQELGKDSFLNMDNKFETYQKRLSIDYREILHCLDNLGLICAHLAAEVCLEKISDTKEESETYKECSMVCKEFLEDILSTIGVYLPQDDKSLVDLQQNHLSAVISGHVSPKLKELFHLLDSFRGDKQKQCLILVERIITAKVIERFVKKEASLAYLNVLYLTENNPSTNVSAQKMQIEIPDLFQHGKVNLLFITDVVEEGFQVPDCSCMVCFDLPKTMCSYSQSQKHAKQSNSKSIMFLERGNPKQRDHLHDLMRREVLIQDPEAPNLKSCPPPVKNGHGVKEIGSMVIPDSNITVSEEAASTQTMSDPPSRNEQLPPCKKLRLDNNLLQSNGKEKVASSKSKSSSSAAGSKKRKELHGTTCANALSGTWGENIDGATFQAYKFDFCCNISGEVYSSFSLLLESTLAEDVGKVEMDLYLVRKLVKASVSPCGQIRLSQEELVKAKYFQQFFFNGMFGKLFVGSKSQGTKREFLLQTDTSSLWHPAFMFLLLPVETNDLASSATIDWSAINSCASIVEFLKKNSLLDLRDSDGNQCNTSSGQEVLLDDKMEETNLIHFANASSDKNSLEELVVIAIHTGRIYSIVEAVSDSSAMSPFEVDASSGYATYAEYFNKKYGIVLAHPNQPLMKLKQSHHAHNLLVDFNEEMVVKTEPKAGNVRKRKPNIHAHLPPELLARIDVPRAVLKSIYLLPSVMHRLESLMLASQLREEIDCSIDNFSISSTSILEAVTTLTCPESFSMERLELLGDSVLKYVASCHLFLKYPDKDEGQLSRQRQSIISNSNLHRLTTSRKLQGYIRNGAFEPRRWTAPGQFSLFPVPCKCGIDTREVPLDPKFFTENMTIKIGKSCDMGHRWVVSKSVSDCAEALIGAYYVSGGLSASLHMMKWLGIDVDFDPNLVVEAINRVSLRCYIPKEDELIELERKIQHEFSAKFLLKEAITHSSLRESYSYERLEFLGDSVLDFLITRHLFNTYEQTGPGEMTDLRSACVNNENFAQVAVKNNLHTHLQRCATVLETQINDYLMSFQKPDETGRSIPSIQGPKALGDVVESIAGALLIDTRLDLDQVWRVFEPLLSPLVTPDKLQLPPYRELNELCDSLGYFFRVKCSNDGVKAQATIQLQLDDVLLTGDGSEQTNKLALGKAASHLLTQLEKRNISRKTSLGDNQSSMDVNLACNHSDRETLTSETTEIQSIVIPFIGPINMKKGGPRGTLHEFCKKHLWPMPTFDTSEEKSRTPFEFIDGGEKRTSFSSFTSTITLRIPNREAVMYAGEARPDKKSSFDSAVVELLYELERRKIVIIQK

SEQ ID NO: 392 - protein, 1493 aa, Artificial Sequence
  Synthetic Construct
MDRKGKGKQVAGSDSYSGGQKRKNSVEFRDEGLRIKKRKNPEVLQFFEESAEVGYYGGSSDEDDDGLGFLNDMEDEPEVEESSKAGKGEKGKSSFVFPKEEDLNEEEFDRIMEERYKPGSGFLRYADDDIKDAIEMDALAPTSKDPPIWKVKCAIGRERRSVFCLMHKFVELRKIGTKLEIISVFSVDHVKGFIFIEADKEHDVLEACKSLVGIYATRMVLLPKAETPNLLTVQKKTKKVSEGTWARVKNGKYKGDLAQIVAVSDTRNKALIKLIPRIDIQALTQKYGGGVTVQKGQTPAPRLISSSELEEFRPLIQVRRDRDTGITFEHLDSLMLKDGYLYKKVSLDSISSWGVIPTKDELLKFTPVDRKETGDVEWISEIYGEERKKKILPTCREGGKGEGSGGGKGEGSGGGKGEGSRGGKGEGSSDFKSESSYELYNLVCFSRKDFGLIVGVDDKGDGYKVLKEGIDGPVVVTVGKKEMQNGPFDSKFTALDLNKKQISVNDVVKISKGPSEGKQGVVRQVYRGIIFLYDESEEENGGYFCCKSQSCEKVKLFTEESNEKTGGFDGTAFEDFVSSPKSPLSPEKEWQPRERYNSSNQGDIGSTYSIGQKLRIRVGPLKGYLCRVIALRYSDVTVKLDSQHKIFTVKSEHLAEVRDRNTVLSTSGDAGTGSFQPFGMLGTESSTGDWAIGAGTSSEGGNWNIGGPSTDSHESLNIERNMVQLCREKNPWGGSKPTSDVSPTVADDNTSAWANAAAENKPASASDQPGGWNPWGKTPASEAGTVSGWGDTSASNVEASSWEKQGASTSNVADLGSWGTHGGSSGGNKQDEDSVWGKLCEASESSQKKEESSWGKKGGSDGESSWGNKDGNSSASKKDGVSWGQQDKGSDESKGGSAWSNQCGDFGSGKKKDGSSGWNKSAEDSNANSKGVPDWGQPNDGSSWGKKGDGAASWGKKDDGGSWGKKDDGNKDDGGSSWGKKDDGQKDDGGSSWEKKFDGGSSWGKKDDGGSSWGKKDDGGSLWGKKDDGGSSWGKEDDGGSLWGKKDDGESSWGKKDDGESSWGKKDDGGSSWGKKDEGGYSEQTFDRGGRGFGGRRGGGRRGGRDQFGRGSSFGNSEDPAPWSKPSGGSSWGKQDGDGGGSSWGKENDAGGGSSWGKQDNGVGSSWGKQNDGSGGGSSWGKQNDAGGGSSWGKQDSGGDGSSWGKQDGGGDSGSAWGKQNNTSGGSSWGKQSDAGGGSSWGKQDGGGGGSSWGKQDGGGGSGSAWGKQNETSNGSSWGKQNDSGGGSSWGKQDGGGGGSSWGKQNDGGGGSSWGKQGDGGSKPWNEHSGGGRGFGERRGGGGFRGGRNQSGRGGRSFDGGRSSSWKTDNQENTWKSDQSGGSDWKKGWGEDSNNSKPSGSSAGGCAGNWPSWDTNSKKETNDKPGDDSKSAWGTSNDQVNTDNNNDSWNKKPNNDVGTSGEADNAWGGKTNAVAPSPSGSAAWGTGDKKTGW

SEQ ID NO: 393 - protein, 238 aa, Artificial Sequence
  Synthetic Construct
KGGRAKLGTDYKDDDDKDYKDDDDKDYKDDDDKGSLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEGSMAGGLNDIFEAQKIEWHEDTGGS

SEQ ID NO: 394 - DNA, 726 bp, Artificial Sequence
  Synthetic Construct
tactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggag

SEQ ID NO: 395 - DNA, 4203 bp, Artificial Sequence
  Synthetic Construct
atggcccctaagaagaagagaaaggtcggtattcacggcgttcctgcggcgatggacaagaagtatagtattggtctggccattgggacgaattccgttggctgggccgtgatcaccgatgagtacaaggtcccttccaagaagtttaaggttctggggaacaccgatcggcacagcatcaagaagaatctcattggagccctcctgttcgactcaggcgagaccgccgaagcaacaaggctcaagagaaccgcaaggagacggtatacaagaaggaagaataggatctgctacctgcaggagattttcagcaacgaaatggcgaaggtggacgattcgttctttcatagattggaggagagtttcctcgtcgaggaagataagaagcacgagaggcatcctatctttggcaacattgtcgacgaggttgcctatcacgaaaagtaccccacaatctatcatctgcggaagaagcttgtggactcgactgataaggcggaccttagattgatctacctcgctctggcacacatgattaagttcaggggccattttctgatcgagggggatcttaacccggacaatagcgatgtggacaagttgttcatccagctcgtccaaacctacaatcagctctttgaggaaaacccaattaatgcttcaggcgtcgacgccaaggcgatcctgtctgcacgcctttcaaagtctcgccggcttgagaacttgatcgctcaactcccgggcgaaaagaagaacggcttgttcgggaatctcattgcactttcgttggggctcacaccaaacttcaagagtaattttgatctcgctgaggacgcaaagctgcagctttccaaggacacttatgacgatgacctggataaccttttggcccaaatcggcgatcagtacgcggacttgttcctcgccgcgaagaatttgtcggacgcgatcctcctgagtgatattctccgcgtgaacaccgagattacaaaggccccgctctcggcgagtatgatcaagcgctatgacgagcaccatcaggatctgacccttttgaaggctttggtccggcagcaactcccagagaagtacaaggaaatcttctttgatcaatccaagaacggctacgctggttatattgacggcggggcatcgcaggaggaattctacaagtttatcaagccaattctggagaagatggatggcacagaggaactcctggtgaagctcaatagggaggaccttttgcggaagcaaagaactttcgataacggcagcatccctcaccagattcatctcggggagctgcacgccatcctgagaaggcaggaagacttctacccctttcttaaggataaccgggagaagatcgaaaagattctgacgttcagaattccgtactatgtcggaccactcgcccggggtaattccagatttgcgtggatgaccagaaagagcgaggaaaccatcacaccttggaacttcgaggaagtggtcgataagggcgcttccgcacagagcttcattgagcgcatgacaaattttgacaagaacctgcctaatgagaaggtccttcccaagcattccctcctgtacgagtatttcactgtttataacgaactcacgaaggtgaagtatgtgaccgagggaatgcgcaagcccgccttcctgagcggcgagcaaaagaaggcgatcgtggaccttttgtttaagaccaatcggaaggtcacagttaagcagctcaaggaggactacttcaagaagattgaatgcttcgattccgttgagatcagcggcgtggaagacaggtttaacgcgtcactggggacttaccacgatctcctgaagatcattaaggataaggacttcttggacaacgaggaaaatgaggatatcctcgaagacattgtcctgactcttacgttgtttgaggatagggaaatgatcgaggaacgcttgaagacgtatgcccatctcttcgatgacaaggttatgaagcagctcaagagaagaagatacaccggatggggaaggctgtcccgcaagcttatcaatggcattagagacaagcaatcagggaagacaatccttgactttttgaagtctgatggcttcgcgaacaggaattttatgcagctgattcacgatgactcacttactttcaaggaggatatccagaaggctcaagtgtcgggacaaggtgacagtctgcacgagcatatcgccaaccttgcgggatctcctgcaatcaagaagggtattctgcagacagtcaaggttgtggatgagcttgtgaaggtcatgggacggcataagcccgagaacatcgttattgagatggccagagaaaatcagaccacacaaaagggtcagaagaactcgagggagcgcatgaagcgcatcgaggaaggcattaaggagctggggagtcagatccttaaggagcacccggtggaaaacacgcagttgcaaaatgagaagctctatctgtactatctgcaaaatggcagggatatgtatgtggaccaggagttggatattaaccgcctctcggattacgacgtcgatgctatcgttcctcagtccttccttaaggatgacagcattgacaataaggttctcaccaggtccgacaagaaccgcgggaagtccgataatgtgcccagcgaggaagtcgttaagaagatgaagaactactggaggcaacttttgaatgccaagttgatcacacagaggaagtttgataacctcactaaggccgagcgcggaggtctcagcgaactggacaaggcgggcttcattaagcggcaactggttgagactagacagatcacgaagcacgtggcgcagattctcgattcacgcatgaacacgaagtacgatgagaatgacaagctgatccgggaagtgaaggtcatcaccttgaagtcaaagctcgtttctgacttcaggaaggatttccaattttataaggtgcgcgagatcaacaattatcaccatgctcatgacgcatacctcaacgctgtggtcggaacagcattgattaagaagtacccgaagctcgagtccgaattcgtgtacggtgactataaggtttacgatgtgcgcaagatgatcgccaagtcagagcaggaaattggcaaggccactgcgaagtatttcttttactctaacattatgaatttctttaagactgagatcacgctggctaatggcgaaatccggaagagaccacttattgagaccaacggcgagacaggggaaatcgtgtgggacaaggggagggatttcgccacagtccgcaaggttctctctatgcctcaagtgaatattgtcaagaagactgaagtccagacgggcgggttctcaaaggaatctattctgcccaagcggaactcggataagcttatcgccagaaagaaggactgggacccgaagaagtatggaggtttcgactcaccaacggtggcttactctgtcctggttgtggcaaaggtggagaagggaaagtcaaagaagctcaagtctgtcaaggagctcctgggtatcaccattatggagaggtccagcttcgaaaagaatccgatcgattttctcgaggcgaagggatataaggaagtgaagaaggacctgatcattaagcttccaaagtacagtcttttcgagttggaaaacggcaggaagcgcatgttggcttccgcaggagagctccagaagggtaacgagcttgctttgccgtccaagtatgtgaacttcctctatctggcatcccactacgagaagctcaagggcagcccagaggataacgaacagaagcaactgtttgtggagcaacacaagcattatcttgacgagatcattgaacagatttcggagttcagtaagcgcgtcatcctcgccgacgcgaatttggataaggttctctcagcctacaacaagcaccgggacaagcctatcagagagcaggcggaaaatatcattcatctcttcaccctgacaaaccttggggctcccgctgcattcaagtattttgacactacgattgatcggaagagatacacttctacgaaggaggtgctggatgcaacccttatccaccaatcgattactggcctctacgagacgcggatcgacttgagtcagctcgggggggataagagaccagcggcaaccaagaaggcaggacaagcgaagaagaagaag

SEQ ID NO: 396 - DNA, 30 bp, Artificial Sequence
  Synthetic Construct
tctagtggtcctcccccaggcaccggtatg

SEQ ID NO: 397 - DNA, 72 bp, Artificial Sequence
  Synthetic Construct
gattataaagacgatgacgataaagactacaaggatgacgatgacaaggattacaaagatgatgacgacaaa

SEQ ID NO: 398 - DNA, 305 bp, Artificial Sequence
  Synthetic Construct
tagaaatctcaaaattccggcagaacaattttgaatctcgatccgtagaaacgagacggtcattgttttagttccaccacgattatatttgaaatttacgtgagtgtgagtgagacttgcataagaaaataaaatctttagttgggaaaaaattcaataatataaatgggcttgagaaggaagcgagggataggcctttttctaaaataggcccatttaagctattaacaatcttcaaaagtaccacagcgcttaggtaaagaaagcagctgagtttatatatggttagagacgaagtagtgatt

SEQ ID NO: 399 - DNA, 20 bp, Artificial Sequence
  Synthetic Construct
gggtttttgcttttcgccat

SEQ ID NO: 400 - DNA, 83 bp, Artificial Sequence
  Synthetic Construct
gttttagagctagaaatagcaagttaaaataaggctagtccgttatcaacttgaaaaagtggcaccgagtcggtgcttttttt

SEQ ID NO: 401 - protein, 1390 aa, Artificial Sequence
  Synthetic Construct
MPKKKRKVGRGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 402 - protein, 1139 aa, Artificial Sequence
  Synthetic Construct
MPKKKRKVSDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVAAILPLSITFDDSLANKVLVYATAAQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFSRADPKKKRKV

SEQ ID NO: 403 - protein, 1100 aa, Artificial Sequence
  Synthetic Construct
MPKKKRKVAAFKPNPINYILGLAIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIAAALPFSRTWDDSFNNKVLVLGSEAQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVRSRADPKKKRKV

SEQ ID NO: 404 - DNA, 102 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngttttagagctagaaatagcaagttaaaataaggctagtccgttatcaacttgaaaaagtggcaccgagtcggtgctttttt

SEQ ID NO: 405 - DNA, 110 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngtttttgtactctcagaaatgcagaagctacaaagataaggcttcatgccgaaatcaacaccctgtcattttatggcagggtgttttttt

SEQ ID NO: 406 - DNA, 128 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngttgtagctccctttctcgaaagagaaccgttgctacaataaggccgtctgaaaagatgtgccgcaacgctctgccccttaaagcttctgctttaacgggcttttttt

SEQ ID NO: 407 - protein, 130 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIY

SEQ ID NO: 408 - protein, 247 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSS

SEQ ID NO: 409 - DNA, 123 bp, Artificial Sequence
  Synthetic Construct
ctcgagatgggatacccatacgacgtcccagactacgcgggaatgggatacccatacgacgtcccagactacgctggaatgggatacccatacgacgtcccagactacgctggaatggtaccg

SEQ ID NO: 410 - protein, 35 aa, Artificial Sequence
  Synthetic Construct
GYPYDVPDYAGMGYPYDVPDYAGMGYPYDVPDYAG

SEQ ID NO: 411 - protein, 9 aa, Artificial Sequence
  Synthetic Construct
SSGPPPGTG

SEQ ID NO: 412 - protein, 27 aa, Artificial Sequence
  Synthetic Construct
MDYKDDDDKDYKDDDDKDYKDDDDKGS

SEQ ID NO: 413 - DNA, 14621 bp, Artificial Sequence
  Synthetic Construct
  misc_feature 157, 158, 159, 160, 161, 162, 163, 164, 165, 166, 167, 168,169, 170, 171, 172, 173, 174, 175, 176: n = A,T,C or G
ggtttcagaattcaaaaaaagcaccgactcggtgccacttggccctgcagacatgggtgatcctcatgttggccaagttgataacggactagccttattttaacttgctaggccctgcagacatgggtgatcctcatgttggcctagctctaaaacnnnnnnnnnnnnnnnnnnnncaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacctcgtcgcaaaattcgccctggacccgcccaacgatttgtcgtcactgtcaaggtttgacctgcacttcatttggggcccacatacaccaaaaaaatgctgcataattctcggggcagcaagtcggttacccggccgccgtgctggaccgggttgaatggtgcccgtaactttcggtagagcggacggccaatactcaacttcaaggaatctcacccatgcgcgccggcggggaaccggagttcccttcagtgagcgttattagttcgccgctcggtgtgtcgtagatactagcccctggggcacttttgaaatttgaataagatttatgtaatcagtcttttaggtttgaccggttctgccgctttttttaaaattggatttgtaataataaaacgcaattgtttgttattgtggcgctctatcatagatgtcgctataaacctattcagcacaatatattgttttcattttaatattgtacatataagtagtagggtacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcaggactctagggactagtcccgggtcttaattaactctctagactcacctaggagctccaccgcggtggcggccgctctagaactagttaattaagaattatcgaaccactttgtacaagaaagctgggcccatgaggcctcatctgggtgtgttcattggctgattagtgcatgaactctgagccaagcatcgaacaaattcttctttcttcttgccaaagttgaagacggcatgctcacggagcacttgctcccgcttaatgtcctccagcgttttctcctttttccatttcagctctttcattttcttctccgcctcactatagttgtccatcgtgcgagaagcagttggctttgcaaatctcacgttcacctcatcacggtttccaagattgaagatccccgttttcctgatgattcctccatccaaagataccgcaccatcacttatgcatgggagggcactaatcatatcggcccttgttttgtaaacttgaaggcgagagaatagattgtagaacaaggtctcacgaagaccatatccatatgatgtgacacagagcaagtaagctggatcgatctgtatcatattcactgcaaatccgagaaacccgggaggacactcaccattaggtaattttggtttcagaagatcaagccttctttgcagatcatcagctatgtgctgaccaacatacggcctcaggttttcaaggcagatggcatcaaaactgtctccaatctctcttccaatcgaagagccaaggcaatgaaggccagcatttatatcaatgttgccatggttatcataagcctctaaagccgtaacactttcataattcctgcatacaactgccaacattgagcgagtccccaaataattcgacaaaatctggctgagattttcatcattgaccttcccaagtttcgctacaacaccaacaacaccttttgtcaacatcaactgagaagcttgagcaccatgaagagtctcaaccagacttaaaactccagcagctgagttttcgtggcgaaggatctgtgcattgatatcttcaccctgaagactgttatcagagttttcacttctaggagtaggagacgagttaagcttactcatatgaacttgcaagtcgacgatagcttcatccattttgtttttctgagacttgagaaacttgagattatcctcatgctgtttgattttgttacccatagcttcaagatcagattcaagcctcttggaattgaacatagcaaactcagcgtgagcaatgcctcctccattctgagtttcatttcttgcaactggtgaagattgatccaaattcatcatccttgttggatcttgaacattcaacggagtggtctgaaacgaaatctgttgaccagtcggatacatggttatatctccttctggccttgacggcccttcagcttttttgtacaaacttgtttgatagcttggcgcgcccttgtcatcgtcatccttgtagtctttatcgtcatcgtctttataatccgccaccttcctctttttcttaggtccgctacctcctcctccgcttcctcctcctccgcttccacctcctccagcgctgtagatacctgagttagcggcgatggcggaagggataggattaccgtctttgaggagcccctgcattgccttcacgatgagttcacagtcagaattggtagcgaaaattgggatagtgagctccatgttcaggtaggacctccaagcggcgacaggcagttcgactccgcccactgtctgggtagccactttggggacctccaccttgatggtatactttctcttctgggcactagactgcctgacgctgcatgtcaccttgtaggcctggctccgtgagttggagctgatccactctgccaccccattagcgaaattagaaggagccactgtcacatcccctgtcccaccattgtccacgagcacgaactgagtaaagtttgaagccatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactacgcaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaaaaaatacagcattgggttggacattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgttcaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgaccatatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggc

SEQ ID NO: 414 - DNA, 163 bp, Artificial Sequence
  Synthetic Construct
  misc_feature 144, 145, 146, 147, 148, 149, 150, 151, 152, 153, 154, 155,156, 157, 158, 159, 160, 161, 162, 163: n = A,T,C or G
aaaaaaagcaccgactcggtgccacttggccctgcagacatgggtgatcctcatgttggccaagttgataacggactagccttattttaacttgctaggccctgcagacatgggtgatcctcatgttggcctagctctaaaacnnnnnnnnnnnnnnnnnnnn

SEQ ID NO: 415 - DNA, 450 bp, Artificial Sequence
  Synthetic Construct
caatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagctt

SEQ ID NO: 416 - DNA, 746 bp, Artificial Sequence
  Synthetic Construct
aaacctcgtcgcaaaattcgccctggacccgcccaacgatttgtcgtcactgtcaaggtttgacctgcacttcatttggggcccacatacaccaaaaaaatgctgcataattctcggggcagcaagtcggttacccggccgccgtgctggaccgggttgaatggtgcccgtaactttcggtagagcggacggccaatactcaacttcaaggaatctcacccatgcgcgccggcggggaaccggagttcccttcagtgagcgttattagttcgccgctcggtgtgtcgtagatactagcccctggggcacttttgaaatttgaataagatttatgtaatcagtcttttaggtttgaccggttctgccgctttttttaaaattggatttgtaataataaaacgcaattgtttgttattgtggcgctctatcatagatgtcgctataaacctattcagcacaatatattgttttcattttaatattgtacatataagtagtagggtacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcaggactctagggactagtcccgggtcttaattaactctctagactcacctagg

SEQ ID NO: 417 - DNA, 1990 bp, Artificial Sequence
  Synthetic Construct
ctgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactacgc

SEQ ID NO: 418 - DNA, 2022 bp, Artificial Sequence
  Synthetic Construct
aaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaa

SEQ ID NO: 419 - DNA, 115 bp, Artificial Sequence
  Synthetic Construct
ggatcatcaacaagtttgtacaaaaaagcaggctctttaaagtatttttacaacaattaccaacaacaacaaacaacaaacaacattacaattactatttacaattacaaaaaaa

SEQ ID NO: 420 - protein, 1465 aa, Artificial Sequence
  Synthetic Construct
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDYPYDVPDYAAAAAEFKREEQARKAKVNNEKKTEIVKPESCSNEGDVKDLKRKDSEDGNEGEEEEASSKPKKPKVALSHLQDIDDTEADQEEEPGGAP

SEQ ID NO: 421 - protein, 1367 aa, Artificial Sequence
  Synthetic Construct
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGG

SEQ ID NO: 422 - protein, 9 aa, Artificial Sequence
  Synthetic Construct
DYPYDVPDY

SEQ ID NO: 423 - protein, 89 aa, Artificial Sequence
  Synthetic Construct
AAAAAEFKREEQARKAKVNNEKKTEIVKPESCSNEGDVKDLKRKDSEDGNEGEEEEASSKPKKPKVALSHLQDIDDTEADQEEEPGGAP

SEQ ID NO: 424 - protein, 616 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGGGGSGGGGSGGGGSGPKKKRKVADYKDDDDKDYKDDDDKGAPSYQTSLYKKAEGPSRPEGDITMYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPR

SEQ ID NO: 425 - protein, 132 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSA

SEQ ID NO: 426 - protein, 15 aa, Artificial Sequence
  Synthetic Construct
GGGGSGGGGSGGGGS

SEQ ID NO: 427 - protein, 9 aa, Artificial Sequence
  Synthetic Construct
GPKKKRKVA

SEQ ID NO: 428 - protein, 17 aa, Artificial Sequence
  Synthetic Construct
DYKDDDDKDYKDDDDKG

SEQ ID NO: 429 - protein, 443 aa, Artificial Sequence
  Synthetic Construct
APSYQTSLYKKAEGPSRPEGDITMYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPR

SEQ ID NO: 430 - DNA, 15906 bp, Artificial Sequence
  Synthetic Construct
  misc_feature 15804, 15805, 15806, 15807, 15808, 15809, 15810, 15811, 15812,15813, 15814, 15815, 15816, 15817, 15818, 15819, 15820,15821, 15822, 15823: n = A,T,C or G
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccaacggtccgactgacgccgcggaagaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggctaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggccgcttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaacttgtttcctaggatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacacctagggtttatgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccggtcgtacgggcggtggcggagggatgtatccgactggtcaacagatttcgtttcagaccactccgttgaatgttcaagatccaacaaggatgatgaatttggatcaatcttcaccagttgcaagaaatgaaactcagaatggaggaggcattgctcacgctgagtttgctatgttcaattccaagaggcttgaatctgatcttgaagctatgggtaacaaaatcaaacagcatgaggataatctcaagtttctcaagtctcagaaaaacaaaatggatgaagctatcgtcgacttgcaagttcatatgagtaagcttaactcgtctcctactcctagaagtgaaaactctgataacagtcttcagggtgaagatatcaatgcacagatccttcgccacgaaaactcagctgctggagttttaagtctggttgagactcttcatggtgctcaagcttctcagttgatgttgacaaaaggtgttgttggtgttgtagcgaaacttgggaaggtcaatgatgaaaatctcagccagattttgtcgaattatttggggactcgctcaatgttggcagttgtatgcaggaattatgaaagtgttacggctttagaggcttatgataaccatggcaacattgatataaatgctggccttcattgccttggctcttcgattggaagagagattggagacagttttgatgccatctgccttgaaaacctgaggccgtatgttggtcagcacatagctgatgatctgcaaagaaggcttgatcttctgaaaccaaaattacctaatggtgagtgtcctcccgggtttctcggatttgcagtgaatatgatacagatcgatccagcttacttgctctgtgtcacatcatatggatatggtcttcgtgagaccttgttctacaatctattctctcgccttcaagtttacaaaacaagggccgatatgattagtgccctcccatgcataagtgatggtgcggtatctttggatggaggaatcatcaggaaaacggggatcttcaatcttggaaaccgtgatgaggtgaacgtgagatttgcaaagccaactgcttctcgcacgatggacaactatagtgaggcggagaagaaaatgaaagagctgaaatggaaaaaggagaaaacgctggaggacattaagcgggagcaagtgctccgtgagcatgccgtcttcaactttggcaagaagaaagaagaatttgttcgatgcttggctcagagttcatgcactaatcagccaatgaacacacccagacgtacgggaggaggatctcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggtggtagcggtggtggtactagtccaaaaacaaggaggagaccgcgaagatcacaacggaaaaggccgcctacgccatggccgtaagtttgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttacgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgcttttttt

SEQ ID NO: 431 - DNA, 1994 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaaca

SEQ ID NO: 432 - DNA, 115 bp, Artificial Sequence; identical to SEQ ID NO: 419
  Synthetic Construct

SEQ ID NO: 433 - DNA, 768 bp, Artificial Sequence
  Synthetic Construct
tagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatct

SEQ ID NO: 434 - DNA, 2018 bp, Artificial Sequence
  Synthetic Construct
ttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaactt

SEQ ID NO: 435 - DNA, 263 bp, Artificial Sequence
  Synthetic Construct
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttac

SEQ ID NO: 436 - DNA, 553 bp, Artificial Sequence
  Synthetic Construct
  misc_feature 451, 452, 453, 454, 455, 456, 457, 458, 459, 460, 461, 462,463, 464, 465, 466, 467, 468, 469, 470: n = A,T,C or G
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgcttttttt

SEQ ID NO: 437 - DNA, 19 bp, Artificial Sequence
  Synthetic Construct
  misc_feature 1, 2, 3, 4, 5, 6, 7, 8, 9, 10, 11, 12, 13, 14, 15, 16, 17,18, 19: n = A,T,C or G
nnnnnnnnnnnnnnnnnnn

SEQ ID NO: 438 - protein, 1692 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVGACGGCATTGGTAGTGGGAGCAACGGCAGCAGCGGATCCCGGTCCGCCGCGEEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 439 - protein, 1369 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDA

SEQ ID NO: 440 - protein, 9 aa, Artificial Sequence
  Synthetic Construct
YPYDVPDYA

SEQ ID NO: 441 - protein, 7 aa, Artificial Sequence
  Synthetic Construct
PKKKRKV

SEQ ID NO: 442 - DNA, 60 bp, Artificial Sequence
  Synthetic Construct
gacggcattggtagtgggagcaacggcagcagcggatccaacggtccgactgacgccgcg

SEQ ID NO: 443 - protein, 241 aa, Artificial Sequence
  Synthetic Construct
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 444 - protein, 1049 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGSLDPGGGGSGSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKGGGRTGRTGGGGGMYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPRRTGGGSRTEEYKLILNGKTLKGETTTEAVDAATAEKVFKQYANDNGVDGEWTYDDATKTFTVTEGGGSGGGTSPKTRRRPRRSQRKRPPTPWP

SEQ ID NO: 445 - protein, 277 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 446 - protein, 237 aa, Artificial Sequence
  Synthetic Construct
SKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYK

SEQ ID NO: 447 - protein, 5 aa, Artificial Sequence
  Synthetic Construct
GGGGG

SEQ ID NO: 448 - protein, 420 aa, Artificial Sequence
  Synthetic Construct
MYPTGQQISFQTTPLNVQDPTRMMNLDQSSPVARNETQNGGGIAHAEFAMFNSKRLESDLEAMGNKIKQHEDNLKFLKSQKNKMDEAIVDLQVHMSKLNSSPTPRSENSDNSLQGEDINAQILRHENSAAGVLSLVETLHGAQASQLMLTKGVVGVVAKLGKVNDENLSQILSNYLGTRSMLAVVCRNYESVTALEAYDNHGNIDINAGLHCLGSSIGREIGDSFDAICLENLRPYVGQHIADDLQRRLDLLKPKLPNGECPPGFLGFAVNMIQIDPAYLLCVTSYGYGLRETLFYNLFSRLQVYKTRADMISALPCISDGAVSLDGGIIRKTGIFNLGNRDEVNVRFAKPTASRTMDNYSEAEKKMKELKWKKEKTLEDIKREQVLREHAVFNFGKKKEEFVRCLAQSSCTNQPMNTPR

SEQ ID NO: 449 - protein, 55 aa, Artificial Sequence
  Synthetic Construct
EYKLILNGKTLKGETTTEAVDAATAEKVFKQYANDNGVDGEWTYDDATKTFTVTE

SEQ ID NO: 450 - protein, 20 aa, Artificial Sequence
  Synthetic Construct
PKTRRRPRRSQRKRPPTPWP

SEQ ID NO: 451 - DNA, 11212 bp, Artificial Sequence
  Synthetic Construct
  misc_feature 11087, 11088, 11089, 11090, 11091, 11092, 11093, 11094, 11095,11096, 11097, 11098, 11099, 11100, 11101, 11102, 11103,11104, 11105, 11106: n = A,T,C or G
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaaccctcaggttcggaaactccggggacctctgaatccgcgacaccggaatcacccgggatgtatccgactggtcaacagatttcgtttcagaccactccgttgaatgttcaagatccaacaaggatgatgaatttggatcaatcttcaccagttgcaagaaatgaaactcagaatggaggaggcattgctcacgctgagtttgctatgttcaattccaagaggcttgaatctgatcttgaagctatgggtaacaaaatcaaacagcatgaggataatctcaagtttctcaagtctcagaaaaacaaaatggatgaagctatcgtcgacttgcaagttcatatgagtaagcttaactcgtctcctactcctagaagtgaaaactctgataacagtcttcagggtgaagatatcaatgcacagatccttcgccacgaaaactcagctgctggagttttaagtctggttgagactcttcatggtgctcaagcttctcagttgatgttgacaaaaggtgttgttggtgttgtagcgaaacttgggaaggtcaatgatgaaaatctcagccagattttgtcgaattatttggggactcgctcaatgttggcagttgtatgcaggaattatgaaagtgttacggctttagaggcttatgataaccatggcaacattgatataaatgctggccttcattgccttggctcttcgattggaagagagattggagacagttttgatgccatctgccttgaaaacctgaggccgtatgttggtcagcacatagctgatgatctgcaaagaaggcttgatcttctgaaaccaaaattacctaatggtgagtgtcctcccgggtttctcggatttgcagtgaatatgatacagatcgatccagcttacttgctctgtgtcacatcatatggatatggtcttcgtgagaccttgttctacaatctattctctcgccttcaagtttacaaaacaagggccgatatgattagtgccctcccatgcataagtgatggtgcggtatctttggatggaggaatcatcaggaaaacggggatcttcaatcttggaaaccgtgatgaggtgaacgtgagatttgcaaagccaactgcttctcgcacgatggacaactatagtgaggcggagaagaaaatgaaagagctgaaatggaaaaaggagaaaacgctggaggacattaagcgggagcaagtgctccgtgagcatgccgtcttcaactttggcaagaagaaagaagaatttgttcgatgcttggctcagagttcatgcactaatcagccaatgaacacacccagatgacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggccgcttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgctttttttgtttaaacaaaccaccccgtgtc

SEQ ID NO: 452 - DNA, 1995 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacag

SEQ ID NO: 453 - DNA, 121 bp, Artificial Sequence
  Synthetic Construct
ggatcatcaacaagtttgtacaaaaaagcaggctctttaaagtatttttacaacaattaccaacaacaacaaacaacaaacaacattacaattactatttacaattacaaaaaaagttaac

SEQ ID NO: 454 - DNA, 4101 bp, Artificial Sequence
  Synthetic Construct
atggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcgga

SEQ ID NO: 455 - DNA, 27 bp, Artificial Sequence
  Synthetic Construct
gactacccgtatgacgtgcccgattac

SEQ ID NO: 456 - DNA, 252 bp, Artificial Sequence
  Synthetic Construct
gctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaa

SEQ ID NO: 457 - DNA, 48 bp, Artificial Sequence
  Synthetic Construct
tcaggttcggaaactccggggacctctgaatccgcgacaccggaatca

SEQ ID NO: 458 - DNA, 1263 bp, Artificial Sequence
  Synthetic Construct
atgtatccgactggtcaacagatttcgtttcagaccactccgttgaatgttcaagatccaacaaggatgatgaatttggatcaatcttcaccagttgcaagaaatgaaactcagaatggaggaggcattgctcacgctgagtttgctatgttcaattccaagaggcttgaatctgatcttgaagctatgggtaacaaaatcaaacagcatgaggataatctcaagtttctcaagtctcagaaaaacaaaatggatgaagctatcgtcgacttgcaagttcatatgagtaagcttaactcgtctcctactcctagaagtgaaaactctgataacagtcttcagggtgaagatatcaatgcacagatccttcgccacgaaaactcagctgctggagttttaagtctggttgagactcttcatggtgctcaagcttctcagttgatgttgacaaaaggtgttgttggtgttgtagcgaaacttgggaaggtcaatgatgaaaatctcagccagattttgtcgaattatttggggactcgctcaatgttggcagttgtatgcaggaattatgaaagtgttacggctttagaggcttatgataaccatggcaacattgatataaatgctggccttcattgccttggctcttcgattggaagagagattggagacagttttgatgccatctgccttgaaaacctgaggccgtatgttggtcagcacatagctgatgatctgcaaagaaggcttgatcttctgaaaccaaaattacctaatggtgagtgtcctcccgggtttctcggatttgcagtgaatatgatacagatcgatccagcttacttgctctgtgtcacatcatatggatatggtcttcgtgagaccttgttctacaatctattctctcgccttcaagtttacaaaacaagggccgatatgattagtgccctcccatgcataagtgatggtgcggtatctttggatggaggaatcatcaggaaaacggggatcttcaatcttggaaaccgtgatgaggtgaacgtgagatttgcaaagccaactgcttctcgcacgatggacaactatagtgaggcggagaagaaaatgaaagagctgaaatggaaaaaggagaaaacgctggaggacattaagcgggagcaagtgctccgtgagcatgccgtcttcaactttggcaagaagaaagaagaatttgttcgatgcttggctcagagttcatgcactaatcagccaatgaacacacccagatga

SEQ ID NO: 459 - DNA, 780 bp, Artificial Sequence
  Synthetic Construct
taactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggccgc

SEQ ID NO: 460 - DNA, 2018 bp, Artificial Sequence; identical to SEQ ID NO: 434
  Synthetic Construct

SEQ ID NO: 461 - DNA, 580 bp, Artificial Sequence
  Synthetic Construct
  misc_feature 455, 456, 457, 458, 459, 460, 461, 462, 463, 464, 465, 466,467, 468, 469, 470, 471, 472, 473, 474: n = A,T,C or G
gtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgctttttttgtttaaacaaaccaccccgtgtc

SEQ ID NO: 462 - DNA, 11209 bp, Artificial Sequence
  Synthetic Construct
  misc_feature 11084, 11085, 11086, 11087, 11088, 11089, 11090, 11091, 11092,11093, 11094, 11095, 11096, 11097, 11098, 11099, 11100,11101, 11102, 11103: n = A,T,C or G
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccagcggcggcgggtcaggcggaggcgggagcggaggcgggggcagccccgggatgtatccgactggtcaacagatttcgtttcagaccactccgttgaatgttcaagatccaacaaggatgatgaatttggatcaatcttcaccagttgcaagaaatgaaactcagaatggaggaggcattgctcacgctgagtttgctatgttcaattccaagaggcttgaatctgatcttgaagctatgggtaacaaaatcaaacagcatgaggataatctcaagtttctcaagtctcagaaaaacaaaatggatgaagctatcgtcgacttgcaagttcatatgagtaagcttaactcgtctcctactcctagaagtgaaaactctgataacagtcttcagggtgaagatatcaatgcacagatccttcgccacgaaaactcagctgctggagttttaagtctggttgagactcttcatggtgctcaagcttctcagttgatgttgacaaaaggtgttgttggtgttgtagcgaaacttgggaaggtcaatgatgaaaatctcagccagattttgtcgaattatttggggactcgctcaatgttggcagttgtatgcaggaattatgaaagtgttacggctttagaggcttatgataaccatggcaacattgatataaatgctggccttcattgccttggctcttcgattggaagagagattggagacagttttgatgccatctgccttgaaaacctgaggccgtatgttggtcagcacatagctgatgatctgcaaagaaggcttgatcttctgaaaccaaaattacctaatggtgagtgtcctcccgggtttctcggatttgcagtgaatatgatacagatcgatccagcttacttgctctgtgtcacatcatatggatatggtcttcgtgagaccttgttctacaatctattctctcgccttcaagtttacaaaacaagggccgatatgattagtgccctcccatgcataagtgatggtgcggtatctttggatggaggaatcatcaggaaaacggggatcttcaatcttggaaaccgtgatgaggtgaacgtgagatttgcaaagccaactgcttctcgcacgatggacaactatagtgaggcggagaagaaaatgaaagagctgaaatggaaaaaggagaaaacgctggaggacattaagcgggagcaagtgctccgtgagcatgccgtcttcaactttggcaagaagaaagaagaatttgttcgatgcttggctcagagttcatgcactaatcagccaatgaacacacccagatgacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggccgcttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgctttttttgtttaaacaaaccaccccgtgtc

SEQ ID NO: 463 - DNA, 54 bp, Artificial Sequence
  Synthetic Construct
cccagcggcggcgggtcaggcggaggcgggagcggaggcgggggcagccccggg

SEQ ID NO: 464 - DNA, 580 bp, Artificial Sequence; identical to SEQ ID NO: 461
  Synthetic Construct
  misc_feature 455, 456, 457, 458, 459, 460, 461, 462, 463, 464, 465, 466,467, 468, 469, 470, 471, 472, 473, 474: n = A,T,C or G

SEQ ID NO: 465-502 - skipped (38 entries)

SEQ ID NO: 503 - protein, 1194 aa, A. thaliana
MDRGGYRGGRGDGRGRGGGGDRGRGYSGRGDGRGRGGDGDRGYSGRGDGHGRGGGGDRGRGYSGRGDGRGRGGGGDRGRGYSGRGDGHGRGGGGDRGRGYSGRGRGFVQDRDGGWVNPGQSSGGHVRGRGTQLQQPPPQEVPPSSSQAQVSQGVAPGDVGQGGVGDVGRDGVGDVGRDGVGDVGQGGVGDVGQVGVGDVGQGGVGDVGQGGVGDVGRDGVGDVGRDGVGDVGRGGVGDRGQSQSGLSSGHFGRGTQLQQPQPQAVSQSSSQGQVSQSFATGGVGLGAWARKPQLFSDSTVLPSSSSSNVVASHTASGSQVMTPKPSSSDKKEPVKRPDKGGNIKVKGVINLSVNHFRVSFSTESVIRHYDVDIKGENSSKKISRFELAMVKEKLFKDNNDFPNAMTAYDGQKNIFSAVELPTGSFKVDFSETEEIMRGRSYTFIIKQVKELKLLDLQAYIDGRSTFIPRDVLQGMDVVMKEHPSKRMITVGKRFFSTRLEIDFGYGVGAAKGFHHTLKPTVQGLSLCLNSSLLAFRKAISVIEYLKLYFGWRNIRQFKNCRPDDVVQELIGLKVTVDHRKTKQKFIIMGLSKDDTKDIKFDFIDHAGNQPPRKISIVEYFKEKYGRDIDHKDIPCLNLGKKGRENFVPMEFCNLVEGQIFPKEKLYRDSAAWLKELSLVTPQQRLENINKMIKSSDGPRGGDIIGNFGLRVDPNMTTVEGRVLEAPTLKLTDRRGNPIHEKLMSESNQWNLTTKGVTKGSIIKHWAVLDFTASESLKKKMPGYFVNKLIERCKGLGMQMEAPIVCKTSSMETLYDGNALEELLRSVIDEASHNHGGACPTLVLCAMTGKHDGYKTLKWIAETKLGLVTQCFLTISAIKGETVSDQYLANLALKINAKVGGTNVELVDNIFSFFKKEDKVMFIGADVNHPAAHDNMSPSIVAVVGTLNWPEANRYAARVKAQSHRKEEIQGFGETCWELIEAHSQAPEKRPNKIVIFRDGVSDGQFDMVLNVELQNVKDVFAKVGYNPQITVIVAQKRHQTRFFPATTSKDGRAKGNVPSGTVVDTTIIHPFEYDFYLCSQHGAIGTSKPTHYYVLSDEIGFNSNQIQKLIFDLCFTFTRCTKPVALVPPVSYADKAASRGRVYYEASLMKKNSKQSRGASSSSASVASSSSSVTMEDKEIFKVHAGIENFMFFV

SEQ ID NO: 504 - protein, 651 aa, Arabidopsis thaliana
MSTLLPFPDLNLMPDSQSSTAGTTAGDTVVTGKLEVKSEPIEEWQTPPSSTSDQSANTDLIAEFIRISELFRSAFKPLQVKGLDGVSVYGLDSGAIVAVPEKENRELIEPPPGFKDNRVSTVVVSPKFERPRELARIAILGHEQRKELRQVMKRTRMTYESLRIHLMAESMKNHVLGQGRRRRSDMAAAYIMRDRGLWLNYDKHIVGPVTGVEVGDIFFYRMELCVLGLHGQTQAGIDCLTAERSATGEPIATSIVVSGGYEDDEDTGDVLVYTGHGGQDHQHKQCDNQRLVGGNLGMERSMHYGIEVRVIRGIKYENSISSKVYVYDGLYKIVDWWFAVGKSGFGVFKFRLVRIEGQPMMGSAVMRFAQTLRNKPSMVRPTGYVSFDLSNKKENVPVFLYNDVDGDQEPRHYEYIAKAVFPPGIFGQGGISRTGCECKLSCTDDCLCARKNGGEFAYDDNGHLLKGKHVVFECGEFCTCGPSCKSRVTQKGLRNRLEVFRSKETGWGVRTLDLIEAGAFICEYAGVVVTRLQAEILSMNGDVMVYPGRFTDQWRNWGDLSQVYPDFVRPNYPSLPPLDFSMDVSRMRNVACYISHSKEPNVMVQFVLHDHNHLMFPRVMLFALENISPLAELSLDYGLADEVNGKLAICN

SEQ ID NO: 505 - protein, 364 aa, Ricinus communis
MHQKLEGGNLALERSMHYGIEVRVIRGFKYAGSFTNKIYVYDGLYKIHDCWFDVGKSGFGVYKYKLMRIVGQPEMGSSVLRFAQSLRTAPLSVRPRGYLSLDISNKKENMPIMLFNDIDNDHDPLCYEYLARTVFPPFAFNQGSSGTGCECIGGCVDGCLCSMKNGGEFAYDQNGFLLRGKPLVFECGAFCKCPPSCRNRVSQKGLKNRLEVFRSRETGWGVRSLDLIHAGEFICEYAGVILTKDQAQVFTMNGDSLIYPNRFSPKWAEWGDLSQIYADYVRPTYPSVPPLDVAMDVSRMRNVACYLSHSSTPNAMVQYVLFDHNNLMFPHLMLFALENIPPLREISLDYGVADEWTGKLSICN

SEQ ID NO: 506 - protein, 709 aa, Glycine max
MNFLFSRENLPPPPGIPIPATIAAANTTPNPILIPKLEPFDELLNTHTPQQQQQSQDPSFSNGSLDLDLDLDLKLVCDETPGAFSGDPSLLSDFNRLSQLFKTAFTNNNAVLDPIAQGLQQLQNDAVSDPLDGTTVVPPQSFQNSDPGMQQQQQYPNGAVSDPDSRAIVPVPEEGRSSSVAVTTPRQRRFKELVRLTDVGGPEQRHFRDVVRRTRMVYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPTCCLSLDVSNRKENVAVRLFNDIDPNYDPLQYEYLVKTNFPQFVFHQSGRGTGCECADGCVEGCFCAMKNGGDFPYNQSGILLRGKPLVFECGPFCRCPPHCRNRVTQKGLKNRLEVFRSRETGWGVRSMDLIQAGAFICEYTGVVLTREQARLLTMNGDSLIYPNRFTDRWAEWGDLSMIDSNFVRPSYPSIPPLDFAMDVSRMRNVACYMSHSSTPNVLVQFVLYDHNNLMFPRLMLFAMESIPPMRELSLDYGVADEWTGKLSICNE

SEQ ID NO: 507 - protein, 682 aa, Zea mays
MDVVESSPSSSPISSPAGSSESIDLNFLPFLKREPKSEPASPELGPLPLPAPPTQTPQQQHAAAPAPEATAPLSPATPDLSSAPVMAPLQSLPPNLDEDALLREYYRLAGLYLSSARSGAIIPALAPEAAAPAVVQSGSGSVVKKRRPRSSDLVRVSSLGVQDQIYFRDLVRRARITFECLRGLLLRDDERAESLGLAAVAGFGVARDRRRVRADLRAAALMGDHDLWLNRDRRIVGPMPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPVGKVYFYDGLYKVVDYWLDRGKSGFGVYKYRLLRIEGQEPMGSVNYRVAEQLKVDVFAIRPTGYLSFDISMGRDTLSVALFNDVDDDQDPLLFEYLARPIFPTSAVQGKFAEGGGGGCDCAEICSIGCNCAGRNGGEFAYDRTGTLLRGKPLVYECGPYCRCPPSCPNRVSQKGLQHRLEVFRSRETGWGVRSLDLIKAGTFICEFSGIILTHQQSEVVAANGDCLVRPSRFPPRWLDWGDISDVYPDYVAPDHPSIPELKFAIDVSRARNVACYFSHSCSPNVFVQFVLFDHYNVSYPHLMIFAMENIPPLRELSIDYGMVDEWIGQLTM

SEQ ID NO: 508 - protein, 570 aa, Medicago truncatula
MNFQDPNPSISRTIVPIPNELQNYDNNTLTGKDSKSKQKLRGQNKELVHTVMDADHRPYREMVRRTRILFDSIRVSGLLEEENNRKNKKNLKASSLVNQTEEVNNSRVRNDLIAATLMKDHGMYLYHDVKIIGTVPGVSIGDIFLYRSEMCVIGLHGQPQAGIDYLHASMSSNGQPIATSVVVSDGYNDDDQGDSIIYSGHGDMKQDQKLERGNLAMVTSMQYEIDVRVIRGFRYEGATSTTSSKVFVYDGLYKIIEFWFEKGISGFGVYKFMLSRVQGQPKMGSMILKEASMLMRGHLCDNHMCVLSDDISNGKENIGVRLYNDIDSDLYPMQFEYLPKAAFPMFLLPQSMTTRKKMRVIECSECVDGCVSSIMNGNTTPYSKSGILLKGRSLIYECGPFCSCPSHCRNRVTQKGIKYRLEVFRSNETSWGVRSLDPILAGTFICEFTGLVLTREQAEILTMDGEHNSLIIYPNRFLNRSTQEWGDLSMIDANHVHPAYPTLDFALDVSMMRNVASYISHSPTPNVFVQLVLFDHGNWMFPHLMVFAMENIPPMRELSLDHGVEARVID

SEQ ID NO: 509 - protein, 533 aa, Physcomitrella patens
MNFEASLNDEAQPNDLDSELYRQRRKRYADLLHFYQQLQEKGESNERIRPDLEATKKMQEEKMNFDWKGVGHVPGSIVGDFFFYRTELFVLGLHRAMQAGIAYTEVGQEKIGCSIVASGGYEDDEDHGETMIYTGHGGNNKADRRQVKDQKPEGGNLALLNSLKYKQPVRVIRGHSDIPTSQSPSKKIYSYDGLYQVVDQSLELGASGFKVFKFKLERLPNQRELGSRLVSFVGKLNKAPSIRTGVVIEDLSGGQEPIPVSVVNTVDDTRPPSSFEYTTKLRYPKGVSLRSSTGCSCKGDSCHSVGHRCSCVLKNSGKMLPYNQYGHLIRAVPAVYECGSRCKCSLECHNRVCQKGLRYRLEIFKTEKKGWAVRSWDFIPSGGFVCEYTGVIMDTKTADELDDDDYLFNLDFKQGNEARWGVQRSDVFDSDDSDMPPLKLSSPKYVIDASKFGGVARFVNHSCTPNLFVQCVLYDHGDLDLPHVMLFAGSDISPFQELTYDYGYALNSVYDSHGNLKKKDCHCGTRSCRKRLY

SEQ ID NO: 510 - protein, 710 aa, Sorghum bicolor
MRREGLGNFGVEEEEAREDGQGSLFMEMDVEESSPSSSLMSSPAGSSDSIDLNFLPFLKREPKSEPGSPELGPLPLPTQTPPPQHAAAPAPAPAPEASVPLPPATPDLSSAPVMAPLQSLPPNQDVDAVLQEYYRLASLYVSSTGSGAIVPAPAPEATAPAVVQSASGSVVKKRRPRSSDLVRVSSLGVQDQIYFRDLVRRARITFECLRGLLLRDDERAESLGLPGVAGFGVARERRRVRADLRAAAIMADHDLWLNRDRRIVGPLPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPVGKVYFYDGLYKVVDYWLDRGKSGFGVYKYRMLRIEGQEPMGTVNYQVAEQLKVDVLAIRPTGYLSFDISMGRETLPVALFNDVDDDQDPLLFEYLARPIFPTSAVQGKFAEGGGGGCDCAGICSIGCNCAGRNGGEFAYDKTGTLLRGKPLVYECGPYCRCPPSCPNRVSQKGLQHKLEVFRSRETGWGVRSLDLIKAGTFICEFSGIVLTHQQSEIVAANGDCLVRPSRFPPRWLDWGDISDVNPDYVAPNHPAIPELNFAIDVSRARNVACYFSHSCSPNVFVQFVLFDHYNASYPHLMIFAMENIPPLRELSIDYGMVDEWVGQLTM

SEQ ID NO: 511 - protein, 684 aa, Oryza sativa
MEMDTSPSSSAPSSPAASSDSIDLNFLPFLKREPKSEPASPERGPLPLPAAAPPPPPPPPPPPPPPQVQAATVATPVPATPDLSAAAVMTPLQSLPPNPEEETLLAEYYRLATLYLSSAGAAGVIVPAAAPEASAGAVAQPGSGSGAKKRRPRSSELVRVSSLSVQDQIYFRDLVRRARITFESLRGILLRDDERAEVLGLTGVPGFGAVDRRRVRADLRAAALMGDRDLWLNRDRRIVGPIPGISVGDAFFFRMELCVLGLHGQVQAGIDFVTAGQSSSGEPIATSIIVSGGYEDDDDRGDVLVYTGHGGRDPNLHKHCVDQKLEGGNLALERSMAYGIEIRVIRAVKSKRSPVGKVYFYDGLYKVVDYWLDRGKSGFGVYKYKMLRIEGQESMGSVNFRLAEQLKVNALTFRPTGYLSFDISMGREIMPVALYNDVDDDRDPLLFEYLARPIFPSSAVQGKFAEGGGGCECTENCSIGCYCAQRNGGEFAYDKLGALLRGKPLVYECGPYCRCPPSCPNRVSQKGLRNRLEVFRSRETGWGVRSLDLIKAGTFICEFSGIVLTHQQSEIMAANGDCLVRPSRFPPRWLDWGDVSDVYPEYVAPNNPAVPDLKFSIDVSRARNVACYFSHSCSPNVFVQFVLFDHYNAAYPHLMIFAMENIPPLRELSIDYGMIDEWVGKLTM

SEQ ID NO: 512 - protein, 678 aa, Brachypodium distachyon
MEVEESSPSSPLSSPSSSPSSDSIDLNFLPFLKREPKSEPASPEHDPLPPPPPPPPPPQAAAAVAVAYVDPTPATPDLSSPAVMTPLQSLPPNPDEDALFAEYCRLASLYLLSAGAGAIVQAPTPEAAAPAVVQPGSGSAVKKRRPRSSELVRVSSLGMRDQIYFRDVVRRARITFESLRGLLLKDDERAEALGLPGVVGLGSTDRRRVRADLRAAALMADRDLWLNRDRRIVGPIPGISVGDAFFFRMELCVLGIHGQVQAGIDYLTAGRSASGEPIATSIIVSGGYEDDDDRGDILVYTGHGGRDPNLHKHCVDQKLEGGNLALERSMAYGIEIRVIRAVKSKRSPVGKVYFYDGLYKVVDFWLDRGKAGFGVYKYKMIRIDGQDAMGSVNYRVAERLKVDALSMRPTGYLSFDISMGRESMPVALYNDVDDDKDPLLYEYLARPIFPSSAVQGKFAEGGGGCECIENCSIGCYCAQRNGGEFAYDKAGVLLRGKPLVYECGPYCRCPPSCPNRVSQKGLKNRLEVFRSRETGWGVRSLDLIKAGAFICEFSGIVLTHQQSEIVAVNGDCLVHPNRFPPRWLDWGDISDVYPGYVPPNHPAIADLNFSIDVSRARNVACYFSHSCSPNVFIQFVLFDHYNMSYPHLMIFALENIPPLRELSIDYGMIDEWVGKLTM

SEQ ID NO: 513 - protein, 519 aa, Populus trichocarpa
RSSELVRVTDLGIEDQRYFRDLVRRTRMVYDSLRILSILEEEKRRGERLGRRARGDLRAASAMRDCGLWLNRDKRIVGSIPGVQIGDVFFFRMELCVMGLHGQAQAGIDYLPASQSSNREPIATSIIVSGGYEDDEDAGDVIIYTGHGGQDKLNRQCEHQKLEGGNLALERSMRHGIEVRVIRGIKHEGSVSSKVYVYDGLYKILDYWFDVGKSGFGVYKYRLLRIDGQPEMGSSILKFAESLRTKPLTVRPRGYLSLDISNKKENMPVFLFNDIDNDHDPLCYQYLERTVFPVFVFTNGSNGTGCDCVSGCSDGCFCAKKNGGELAYDENGFLLKGKPVVFECGVSCRCPPTCRNRVTQRGLRNRLEVFRSRETGWGVRSLDVIHAGAFICEYAGVVLTREQAQIFTMNGGGLVYPNRFSAKWAEWGDLSQIYPNYTRPSYPELPPLDFAMDVSKMRNVACYMSHSSAPNVLVQFVLYDHNNLMFPHIMLFAMENIPPLRELSLDYGVADGWTGKLAI

SEQ ID NO: 514 - protein, 672 aa, Vitis vinifera
MGSLIPFQDLNLLPDPATSPSTAATAITPALIFPKIEPKLEPFDAPTLPLQSFPQNPSPNFFVNSGQLPFVGPGSNPNDTVFSQTPEGSPEENNVYSEYYRISELFRTAFSKRMENLGNIEVLDPDSRAIVPVPEETRISNVVVSRRRDQRSSELVRVTDLTIDHVRYFRDLVRRTRMLYDALRIFSMMEEEKRREVGLITRRSRGDLRAAKLMKDRGLWLNRDKRIVGSIPGINIGDLFLFRMELCVVGLHGQAQAGIDYLPGSRSSNGEPIATSIIVSGGYEDDQDEGDVLIYTGHGGQDKFSRQCDHQKLEGGNLALERSMHYGIEVRVIRGIKYEGSVTGKVYVYDGLYKIHDSWFDVGKSGFGVYKYKLLRNEGQAEMGSAILRFAENLRVSPLTVRPVGYLCDDLSTKKENIPVFLFNDIDGDNEPMYYEYLPRTVFPLHAYNLGGNGSGCDCVAGCTDDCVCAQRNGGEFAYDQNGFLLRGKPVIFECGSFCRCPPTCRNRLTQKGLRNRFEVFRSRETGWGVRSLDLIQAGAFICEYAGVVLTREQAALFSMNGDTLIYPNRFTDRWAEWGDFSKVYSDYVRPMHPSIPPLDFAMDVSRMRNLACYMSHSSCPNVLVQFVLYDHHNLLFPRLMLFAMENIPPLRELSLDYGVADEWTGKLPICN

SEQ ID NO: 515 - protein, 695 aa, Cucumis sativus
MDSPIPFQDLNLLPDPSSTAVMTAATSPKTATGINSSFNKFVDTGKLLTPKLEPKLEPFDDLFETRESQQPQSVQQPFLSTPSSNFFSNTDFSQTPFSDQNHTPLSQSSSISSDKDNVYSEFYRISQLFRSAFGKGLQSYGDADVEVVDPDAQAIVPVPEENQISTVVVSKRRYDKRSSELVRVTDLGVEDQRYFRDVVRRTRMIFDSLRVLSTAEEEKSPGLMRRLRGDLRASSLMRERGLWLNRDKRIVGSIPGVHIGDLFFFRMELCVVGLHGQAQAGIDYVPASQSSNGEPIATSIIVSGGYEDDEDAGDMIIYTGHGGQDKFSKQCMHQKLEGGNLALERSMHYGIEVRVIRGMKYAGSVASKIYVYDGLYRILDCWFDVGKSGFGVYKYKLLRIDGQAEMGSSILKFAENLRTKPLSLRPSGYLSLDISMKKEAVPVLLFNDIDNDQEPLYYEYLVRTVFPPFAFHQSGSGTGCSCVTSCVHDCFCAMKNGGEFGYDQNGFLVRGKPIIFECGPFCQCPPQCRNRVSQKGLKHRLEVFRSRETGWGVRSLDLIHAGAFICEYAGVVLTREQAQVFSMNGDTLIYPNRFSDRWAEWGDLSQIYSNYVRPSYPSVPPLDFAMDVSRMRNVACYISHSTSPNVLVQFVLYDHNNLMFPHLMLFAMENIPPLRELSIDYGVADDWSGKLAICN

SEQ ID NO: 516 - protein, 654 aa, Arabidopsis lyrata
MSTVVPFPDLNLMPASQSSTAGTTAGDTVVTGKLEVKAEPVEECQTPPSSFSDQSASTDLIAEFIRISKLFRSAFKPHQIEGLDGVSVYGLDSGAIVTVPEEENRELIKPPPGFGDNRVSTVVVSPPPTKFERPRELARIAILGHDQRKELRQVMKRTRMTYESLRIHLMAESMKNPVLGQGRRRRSDMAAAYIMRDRGLWLNYDKHIVGPISGVEIGDIFFYRMELCVVGLHGQTQAGIDCLTAERSATGEPIATSIVVSGGYEDDEDTGDVLVYTGHGGQDKQHKQCDNQRLVGGNLGMERSMHYGIEVRVIRGIKYENSISSKVYVYDGLYKIVDCWFAVGKSGFGVFKFRLVRMDGQPMMGSAVMRFAQTLRSKPLMVRPTGYVSFDLSNKKENVPVFLYNDVDGDQEPRHYEYIAKSVFPPGIFGQGGISRTGCDCKLSCTDDCLCARKNGGEFAYDDNGHLLRGKDVVFECGELCTCGPNCKSRVTQKGLRNRLEVFRSKETGWGVRTLDLIEAGAFICEYAGVVVTRHQAEILSMNGDVMVYPGRFTDKWRNWGDLSQVYPDSVRPDYPSLPPLDFAMDVSRMRNVACYISHSKDPNVMVQFVLYDHNHLMFPRVMLFALENISPLAELSLDYGLADEVNGKLAICN

SEQ ID NO: 517 - protein, 650 aa, Arabidopsis thaliana
MGSSHIPLDPSLNPSPSLIPKLEPVTESTQNLAFQLPNTNPQALISSAVSDFNEATDFSSDYNTVAESARSAFAQRLQRHDDVAVLDSLTGAIVPVEENPEPEPNPYSTSDSSPSVATQRPRPQPRSSELVRITDVGPESERQFREHVRKTRMIYDSLRMFLMMEEAKRNGVGGRRARADGKAGKAGSMMRDCMLWMNRDKRIVGSIPGVQVGDIFFFRFELCVMGLHGHPQSGIDFLTGSLSSNGEPIATSVIVSGGYEDDDDQGDVIMYTGQGGQDRLGRQAEHQRLEGGNLAMERSMYYGIEVRVIRGLKYENEVSSRVYVYDGLFRIVDSWFDVGKSGFGVFKYRLERIEGQAEMGSSVLKFARTLKTNPLSVRPRGYINFDISNGKENVPVYLFNDIDSDQEPLYYEYLAQTSFPPGLFVQQSGNASGCDCVNGCGSGCLCEAKNSGEIAYDYNGTLIRQKPLIHECGSACQCPPSCRNRVTQKGLRNRLEVFRSLETGWGVRSLDVLHAGAFICEYAGVALTREQANILTMNGDTLVYPARFSSARWEDWGDLSQVLADFERPSYPDIPPVDFAMDVSKMRNVACYISHSTDPNVIVQFVLHDHNSLMFPRVMLFAAENIPPMTELSLDYGVVDDWNAKLAICN

SEQ ID NO: 518 - protein, 364 aa, Ricinus communis; identical to SEQ ID NO: 505

SEQ ID NO: 519 - protein, 709 aa, Glycine max; identical to SEQ ID NO: 506

SEQ ID NO: 520 - protein, 682 aa, Zea mays; identical to SEQ ID NO: 507

SEQ ID NO: 521 - protein, 570 aa, Medicago truncatula; identical to SEQ ID NO: 508

SEQ ID NO: 522 - protein, 533 aa, Physcomitrella patens; identical to SEQ ID NO: 509

SEQ ID NO: 523 - protein, 710 aa, Sorghum bicolor; identical to SEQ ID NO: 510

SEQ ID NO: 524 - protein, 684 aa, Oryza sativa; identical to SEQ ID NO: 511

SEQ ID NO: 525 - protein, 678 aa, Brachypodium distachyon; identical to SEQ ID NO: 512

SEQ ID NO: 526 - protein, 519 aa, Populus trichocarpa; identical to SEQ ID NO: 513

SEQ ID NO: 527 - protein, 672 aa, Vitis vinifera; identical to SEQ ID NO: 514

SEQ ID NO: 528 - protein, 695 aa, Cucumis sativus; identical to SEQ ID NO: 515

SEQ ID NO: 529 - protein, 654 aa, Arabidopsis lyrata; identical to SEQ ID NO: 516

SEQ ID NO: 530 - protein, 349 aa, Arabidopsis thaliana; identical to SEQ ID NO: 14

SEQ ID NO: 531 - protein, 420 aa, Arabidopsis thaliana; identical to SEQ ID NO: 448

SEQ ID NO: 532 - protein, 163 aa, Solanum lycopersicum
MKDVIGIVALLGKVDDDNLSRKGPMNKSSGLHGVGASIGRPLDDRYLVIFLENLRPYAGEFIVDDPQRRLAIRRKPRYVNEETPHVFLGFAVNMINIDTANLYCVTRTGYGLRETLLYGLFSQLQVYKTSADMMEALPFIIDGAISLDGGIIKSGGIFSLGKR

SEQ ID NO: 533 - protein, 1790 aa, Solanum tuberosum
MSSKRQCDDFSAETPRKKPSRVLRIQVDSDEEVGTNEGRVFYFRVLLPNGITLELQVPGPPSEMPVEDFVILVRREYQNLGRRTESPKPKRQINWTSKDLHFVDAFENRITKMLDFRKFKSNKSHMIRLCDGSAEADKYENMWDLTPDTDLLKELPEEYTFETALADLIDNSLQAVWPKSTDQRRLISLELTKSRITIFDTGLGMDGSAENSIVKWGKMGASLHRLSRDRGIGGKPPYLTPYFGMFGYGGPIASMHLGRRASVSSKTKECKKVFVLHLERDSLLRCSSSQQTWRTDGNVRDPLEDELRYSVDGSFTKVEIFYPKMRSESVQKLQYKLKDIYFPYIQCDEVSKTGKTVMPIEFQVNGTNLAEIEGGEVATTNLLSCNGPEFVMQLSFHVKDSNSLKIGSGTKSSFEGHARLRCVYFPMVQGKESIEVILEKLEADGYGITENFETFSHVSVRRLGRLLPDARWSWLPFMEPKLRKSDRAEVLKRCCFRVKCFIETDAGFNPTPSKTDLAHHHPCTIALRNFGNKPSDKENDVLIEISKDGKKLSLLQLEKLYQDWLLQMHDRYDEEIDCGEDQPTFVIGPSHKKELGVSADVLRIHKAFQRKGITWKAGQKIKILKGACRGFHKNNIFATLEFIILEGWQGDSGGEARIICRPLHVPAESGCRLTFDEGCACFEIRDSKSFPISVIDAGKCLAVDNTEWENQILKHQEKTTPSSIDILDAEQCQELDIKGALPQDVDAGHEPPEEITAVVRPASFSSVTAYKNLDQKYIMKENFEMTLEIKFKADENEKERHIYSGQLNPSSLKGFHGLYIFPLKKKSPNLFQKAGIYLFRFSLIESRTISVKEVRVKALPEAASWELVSDGKSTHSVRVGSCFPEVFSVACCDRFCNRIPFKSQTEIEMKLCSGGRAISSECSYDQCITHDRYTMKFKNVTIESSELDMIRPSYKATLHINSKEDPFFVAIPCAVIPGPLQRILLRPVDFGKKLVPGMVLKELALETFDKYGNHMRKDEHIKLTLEGLHLLDKGDSFYKVDDHGCVNLSGTLKVTAGYGKLVSLSVLSGDKVVFKKEFQTDRRSLRVASKVPKVCAAGSHLEDVVFEVINSAGEVDEDIDSEVEDGHSHTLLIRQDSLREEDNVRYSFHHGRCIVRSIPLPDNEGLFCFVASHSRFHELQTSIEVHVEKAVIRTHELTQPRSPKKEILLHEDSNGKGPETVCHNTFDGRIMIFNDSCASMDLEDRLQTVTKLECVSRQKLGDDICRYGLCIRRCDANVESLNIKQSNIELEMSNLGVVWLYVVRKLFNWHMKSKSNVMCIMNHAYVKPTAWHGHMQKAVVTSSLNHDLEPCSFKPKDYYLRRLHLLYILLYLLAFRLRSVNVSERSEPKSRNIDCWHQVHVVISLFGWFKCSPDISFLFLMSLEFSLNFSLLSVPGAITSLAISQSVKLKEIINCNMKLVMDAAFIGLDSFHDLGYDKDVIMEKIEGKADSAAAVIHKLLRSPKPEQLYLKYAHDILGVVALLGEVRTHKLSSMFSTYLGEDQMLAVVCKSRAAARALENYRMDGNVNCASALDILAAKLGISIKGRYLVICLEDIRPYKQGVSSDPQRELAIPHPTLSNRETPPGFLGYAVNMIFLPAEYLQLRTASGHGLRETLFYRLFGKLQVYKSREQLYMASSCIEEGAVSLDGGMMRGNGVVSASVGSEEPYILFPVICLERQLLLSPEKVKRLKRIEELKLERNQLQDQIQEELRNEAKYKKKLAKKLRDKKQIDDQLEPSPGMYSSDMDISC

SEQ ID NO: 534 - protein, 350 aa, Phaseolus vulgaris
MSQLNHTQSLRDDISERSKIIKQHEDNLKFLNSQSNQLAESIFDLQVSLAKYHSNNVITSDSGNGAFHTEEETMEQIMKKENTAAGVFSWLKGNAQTSNLTLTKDVVGVVATLGKVESDNLSRILSEFLGLERMLAIVCSSYEGINALEKYDTEGLINCNAGLHGIGSSIGKRINGRFAVISLEDLRPFVGGLVADDPQKKLALPKPRLPNGECPPGFLDYAVNMIHLDSKHLSFLTDIGHGLRETLFYGLFSRLQIYKTRNEMLLALPCIYDGALSLDGGMIQRGGMFALGCRKDVEVKFPLISGGSDVPSNYIETEETVRKLNWETSKLSADKHREQQLLDYRKGNLH

SEQ ID NO: 535 - protein, 431 aa, Vitis vinifera
MFQPHNQLSIQTKPLAIQEPSALMHVDPNNSFGAARDEMHNGGLSKAESAVNNSKKLQDELQTLGFKIKQHEDNIKYLKTQKDNLDGSILDLQVTLGKYCSSSIPTMENEALSKSRSENETVEQILKYEKSAAAILCQLKIRHGSQASHLTLAKDVLGIVATLGKVDDENLSRLFSEYLGLETMMAIVCKTYEGVKTLETYDFEGGINKHSGLHGLGSSIGRHLDGRFRIICLEHLRPYAGDFVADDTQRRLDLLKPRLPNGECPPGFLGFAVNMINVDSANILCLTSSGCGLRETLFYNLFSRLQVYRTRAEMLLALPCITDGALSLDGGMIKTAGVFSLGSREDVEVRFPKSSGSNLPLEYFETEKELTEVNWKREKVEEDIQREQSLLNHINYTFRIKKQAFIKYLADSSPYGIQQQIPGERERLTQR

SEQ ID NO: 536 - protein, 1596 aa, Theobroma cacao
MQSQFNAMEDKFHRRASKRPLVLEDEDDADGSNEVYRFKVLLPNGTSVDLSLKNQKPEISFEDFIDLIRVEYDYIVRSQRQSVKRKRIINWNSEKLYLEGDMGGKIMSRIKLRHFKPLKCHILRLHDGSGEVANTYENMWDLTPDTDLLMELPEEYTFETALADLIDNSLQAVWLNGKNERRLISVNVLENTISIFDTGPGMDSSDENSIVKWGKMGASLNRLSKVQAIGCKPPYLMPFFGMFGYGGPIASMHLGSCAIVSSKTKESKKVYTLQIAREALLNNSNPERCWRTDGGIRDASEDEIEKSPHQSFTKVEILKPKQKNLDIFKLQCKLKDTYFPYIQCDELSKVGRTITPVEFQVVNGVDLTEIDGGEAAITNLLSCNGPEFSILLHFSLRRENVATKGSKASQEANARLKCIYFPIRQGKENIERILERLGAEGCGVRENYEDFSRVSIRRLGRLLPDARWALLPFMDLRQRKGDKSHLLKRCCLRVKCFVETDAGFNPTPSKTDLAHHNPFSIALKNFGSRHVEKEKDVDVDIYRGGKQLTFLQLEREYQDWLLLMHDSYDEEIVSGEDQPVLVVGPLNKKALGISSDVIRVHKILKRKGVLWKRRQRIKVLKGACAGFHKNNVYATLEYFLIEGFQGDFGGEARIICRPLGLSNGSILSVKDGNASFDIRSSLSLPVSVIDSGKCLAIDDTDWDCQLEKQCQKAPSRIDLLNAKQCQELEVDGALPADATVHAGLVPPKEIVAVLRPRSFGSSSASNDLEQKDILKINLEMSMEVNFRRTKNHQDVKHIYSGRITPSSHKGFNGLYVFPIGSKFTHLFQVAGLYTFLFSIEHSGCQDCKKTLLVVPSLKVGKWRLLSDGKIPSYNVRVGSCFALIPIACYDIYGNRMPFSSIPNFKIKLVMNEGMLVDVTQMKPSLSSDNLVLNIEDVMIESNGLDSMRPHYAATLVIYSKDESVSISVECQVTPGALRNVRACPEVLGNQLLPGFIIEQLVLEMFDAYGNHVAEGAEVQFHLDGFVIQGHLGSKYKVDDRGCIDLGGLLEVTAGYGKSVSLSVLHDGKVVFKREFQTEKRELRIASVVPERCIAGSILEDLAFEVVDSQGVVDETFHDDEKHGQSHRLIVNSESFETCDSICYAFIHGCCIVTSIPLPEIEGPFCFVAFHSRYMDLYLNVKVSLVRPRKVESDEIEYPSDQKGLFLQKSQSVKDVGCLLSLVKYDKELEDEVCKYGERIAKWEHLLETLDCRKASIERYVSGLQASLEPNLIDNLDSLSTKEEMMIRIKERDHSAASVLCSLAQKLPFQEPWMDVIEGLVGVVALLGTVCTSKLSRILAEYLGEDQMLAVVCKSYTAARALEKYEHNGKVDWKLGLHAEATALGKSISGRFLVVCLEDIRPYPGLIEVSDPQRKLALPDPRLPTGNTPPGFIGYAVNMVNIDHPHLENLTTAGHGLRETLFYRLFSKLQVYETREHMENARACIKHSAISLDGGILRKNGIISLGYRNPEIHFPVQMHVSQQHKEIMEQIKKMKLELRSILQHIERISENHAKASKKFNKRKMKLEKCMDRMDSTIKYYHVEYAPNTLKSEEAPPM

SEQ ID NO: 537 - protein, 1261 aa, Glycine max
MVLFEMQNMWDSTPDTDLLLELPEEYTFETALADLIDNSLQAVWSNGEDKRKLIRVNLGKSKISIFDNGPGLDDTDENSLVKWGKMDASLHRSSKSKAIGGKPPYLMPYFGMFGYGGPIASMHLGRRASVSYKTKHVKKVYTLHLEREALLNTSSSQLTWKTGGGIRDPLANEIRDSHGSFTKGESSVTEYFNVLYRHWQQLDIYEKVSRCGTKDKKKYKELGTDRIYKFLLGLNKDLDEVRGRILGFKPLPKIREVFSKQEETSLDHHKRKTTPGVIIVRGQATPRKHAGSSMQFKSKEGRGNTAFNHQQAEVNSNSSSFSKEQMEALQTLFQQSMILELGKTIGNAEECVGLYLFQVEKPKELKNHSYVAASVPSSDNSVMWHCRLGHPNFILNRYKVRFVAKGFTQSYGVDYEETFALVAKLNFVRCDDTSDRGKTITPIEFKVNDVDLTEIQGGEVAITNWHSCNGPEFVFQLHLKSESSRELQANARMRFVYLPFTKGKENIERVLEKLKSDGFVISEDFQSFSRVSVRRLGRLLPDARWTLLPFMDFRNKKGIKAQILKRCSQRVKCFIETDGGFKPTLSKTDLAHHNPFTAALKNFGNKFSEKEKDVTVEIRKATKVLTLLKLQMEYQDWILQMHHQYDEEADSGEDQPVIIVGPANEKALGISSDVIRVHQVLNRKEKSWKRGQKIKVLKGACAGCHRTTIYATIEYFLLEGFEGDAGGEARIICRAIDIPDENGSFLSVGDEDASLEIRGSLSLPISVIDSGKVIAVESIEWENRLTKKQQKSTSIYLPGANHYENLETNGVVSVESIEWENRLYKKQQKSPSINLSGANHYEHLEADGVPVIKMPIVKYAGQPPCTDKGIIDLQEPSLYHENSLIEFFLNYDKELFDSICKLAERIQKVESHLNNSNEKKAETEQEMVKLLEKVEPYQLSIMDSSFTKDELMTKIRSMENSPYSVLCSLSKREKPPNYFLEDLIGVVALIGTVQRPELSRILAEYLGEAKMLGLIYRSFDTASSLEKYNQKGEIDYERALHAEAAALGKAISNRFHVICFEDIRPYTGWLHDDSQRRLALPNPRIANGETPEGFIGYAVNMVDLDINSLQIMTASDFGLRETVLFNLFKKLQVYNTRENMVAARTCIEDGAVSLDGGILSENGILSLGYGNPSICFPCENQKVLPREIEKILPQMEGKKSDLRMIEERIKGLEHSRAKYIKKFNKKKERYDKVTDRMKPMTELLKYKPEAGDGSNSSGRLS

SEQ ID NO: 538 - protein, 418 aa, Oriza sativa
MAVQSAERGVEAPPLTLSIFEFNSKVMQDELQKLALKVNHHEENIRFLKSELNAVEDSCADLGIKIGNYYSSMAAIANNDTSVEEAEQRTIQSILKQDETAAGIICQLKIRHYQHASKLPLMKDVLGVVATLGKINNDNLSRVLSEYLGLDNMLGVVCKTYDGVEGLETYDKEGMVDKTSGIHGLGRTIGKFLDGRFTVFCLENIRPFSGDFMIDDPQRKLLLHKPRLPSGEFPPGFLGFAVNMIHLDQANLSCLTAGGHGLRETLFYSLFSQLQVYKTRAELRNAIPLINDGAVSLDGSILRPNGSFCLGNRASLGIQFPVTANLGVSNLPVTITELEEQVKHKNWEKERLLEDIKRQEDLLNQVKDLFSKKKEQFMAYITQPGMLQRASQASPTIPSPATPGSNPFGSRPPHLRGR

SEQ ID NO: 539 - protein, 344 aa, Oriza sativa
MAAIANNDTSVEEAEQRTIQSILKQDETAAGIICQLKIRHYQHASKLPLMKDVLGVVATLGKINNDNLSRVLSEYLGLDNMLGVVCKTYDGVEGLETYDKEGMVDKTSGIHGLGRTIGKFLDGRFTVFCLENIRPFSGDFMIDDPQRKLLLHKPRLPSGEFPPGFLGFAVNMIHLDQANLSCLTAGGHGLRETLFYGLFSQLQVYKTRAELRNAIPLINDGAVSLDGSILRPNGSFCLGNRASLGIQFPVTANLGVSNLPVTITELEEQVKHKNWEKERLLEDIKRQEDLLNQVKDLFSKKKEQFMAYITQPGMLQRASQASPTIPSPATPGSNPFGSRPPHLR

SEQ ID NO: 540 - protein, 405 aa, Zea mays
MATPSLPTQIVEFNYKAIEDKLKRLALEVSHHENNIRFLKSQLNTVEEACVDLGIKLGNYHSSVAAVVNNDTSAQEAEQRTIRSILDQGKTAAGIICQLKVRHHELASKMPLMKDILGFVATLGKVNNDNLSRLLTEYLGMDNMLALVCKTYDGVKGLEKYDKDGIIDNTSGIHGLGRSVGKFLDGRFTVFCLENLRPFSGDVIIDDPQRKLILHRPRLPGGESPPGFLDFAVNMIHLDRAHLRFLTASGHGLRETLFYTLFSHLQVYKTRTDIQSALPLIKDGAVSLDGGLLRPNGSFCLGHSKNLEVKFPVTTDVSSLPENVAEMEEQVKRKNWEKEMVLEDMKREEDLLKQVKELYRKQKQELMDYVTQPAVTQMSRDSPATHSPATPGSNPFGAKLSNKWR

SEQ ID NO: 541 - protein, 388 aa, Sorghum bicolor
MEDKLKRLALKVGHHEDNIRFLKSQLNAVEDACIDLGIKLGNYHSSVAAVMNNDTSAQEAEQRTIRSILDQDTTAAGIICQLKVRHHELASKMTLMKGILGFVATLGKVNNDNLSRLLTEYLGMDNMLALVCKTYDGVKDLEKYDKDGIIDKTSGVHGLGRSVGKFLDGRFTVFCLENLRPFSGDINIGDPQRKLILHRPRLPGGESPPGFLDFAVNMIHLDRAHLSCLTASGHGLRETLFYTLFSHLQVYKTRADIQSALPLIKDGAVSLDGGILRPNGSFCLGDSKNLEVRFPVNIEVSSLPENIAEMEEQVKLKNWEKERVLEDMKREEDLLKQVKELYRKQKQELMDYLTHPAVAQTSRDSPTTHSPTTPGSNPFGAKPSHKGW

SEQ ID NO: 542 - protein, 663 aa, Arabidopsis thaliana
MSHDRSVNVSHDAVIAKPERGTMLQSFSPRSHGSKGYSLPQDSEENRGSVGQSAGQSSTSVVDQVRSPADDAGVTSSSTICPAPVCRQFWKAGSYNDELSSKSQQPNGKNYLHVHPMFLHSNATSHKWAFGAVAELLDNAVDEIQNGATFVIVDKTTNPRDGATALLIQDDGGGMDPQAMRHCMGFGFSDKKSDSAIGRYGNGFKTSTMRLGADVIVFSRHSKNQTLTQSIGLLSYTYLTRTGHDRIVVPILDYEFNASAGEFKTLQDREHFISSLSILLEWSPFSTEAELLQQFDDVGPHGTKVIIYNMWLNSDAKLELDFDSVAEDILIEGSIKKTGSKIVNDHIASRFSYSLRVYLSILYLRIPETFKIILRGKVVEHHNVADDLMHPQYILYKPQAAGSEEALVVTTIGFLKEAPKVNLHGFCVYHKNRLIMPFWQVINYSSSRGRGVVGVLEANFVEPTHNKQDFEKTVLLQKLENRLKEMTVEYWSCHCVLIGYQVNKKPRLQIPQKVQPAGRQALSPPPGFQAVFPQGNTTSLPRVSTQPVLLEKRKEHPDSVASAALKRKVGNDDFTVPGHIRVEQFIHGSASQSQDIETVKLMEENKKLRAKCLDRKVRSQNLEVKAMNLRSELENYKSEYERLMVELQALDLVKDEHRRNVNT

SEQ ID NO: 543 - protein, 718 aa, Solanum lycopersicum
MSSTNMVGLCSNNLGGGEIETVKLEPILVESLIPQMECCEADSLPYKKSSSSCGRQDSTATEQSRTSVLDQDQSPIDDSSLCSTSQICPAPLSRQFWKAGNYDEGHATKSTLKKGSSFLHIHPKFLHSNATSHKWAFGALAELLDNAVDEIQNGASFVIVDKTPNPRNGSSALMVQDDGGGMDPEAIRRCMSFGFSDKKSASTIGQYGNGFKTSSMRLGADVIVFSRCKKNRKLTQSIGLLSQTFLTRAGLDKIVVPLLDFEFSAAAKKWSSLHGEQHFRNNLSLLLRWSPFATEAELLKQFDDIGDHGTKVIVYNLWYNDEGRMELDFEADSEDIRLSGEANDNEKNASRIKVTDQHLANRLRYSLRAYLSVLYLRIPDNFCILLRGRVVELHNIAKDLKYPEFIMYKPQTLGFKEGSVITTIGFLKEAPVVNIHGFNVYHKNRLILPFWHVVRYSDSRGRGVVGVLEANFIQPTHNKQDFEKTPLFQKLEVRLKEMTWEYWDYHCGLLGYFPKKRPQGPITPQASSESRQQHGSYKPIVLGNSSGAVGSNITVRRTVTSEASSESRQQHGSYKPAVLGNSSGAVGSNITVWGTVTPVFQNNSKQGASKRKAVDHPIEHENLKRTAGLIVDLTGGERSQEILTLTSSGSQDQEAAHLIQENEKLRAQCCECEKREEELHSKVNKLRKELKEAQRTYAHMLVESRLLDKVKPEEDVYI

SEQ ID NO: 544 - protein, 830 aa, Solanum tuberosum
MWMQEDDLVVVEKDPGMSSTNMVGLCSNNLGGGETETVKLEPELVGSSLPQMEYCEADSLPYQKSSSSGGRQDSTATEQSGTTVLDQDQSPIDDSSLCSTSQICSAPLSRQFWRAGNYDEGRATKSTLKKGSSFLHIHPKFLHSNATSHKWAFGALAELLDNAVDEIQNGASFVIVDKTPNPRNGSSALMVQDDGGGMDPEAIRRCMSFGFSDKKSASTIGQYGNGFKTSSMRLGADVIVFSRCKKNRKLTQSIGLLSQTFLTRAGLDRIVVPLLDFEFSAAAGKWSSLHGEQHFRNNLSLLLRWSPFVTEAELLKQFDDIGDHGTKVIVYNLWYNDEGRMELDFEADSEDIRLSGDANDNEKSGSRIKVSDQHLANRLRYSLRAYLSVLYLRIPDNFCILLRGRVVELHNIAKDLKYPEFIMYKPQTLGFKEGSVITTIGFLKEAPVVNIHGFNVYHKNRLILPFWHVVRYSDSRGRGVVGVLEANFIQPTHNKQDFEKTPLFQKLEVRLKEMTWEYWDYHCGLLGYFPKKKPQGPITPQTSSESRQLHGSYKPVVLGNSSGAVGSNITVRGTVTSQVSSESRQQHGSYKPVVLGNSSGAVGSNITVRGTVTSQASSESRLQQGSYKPVVLGNSSGAVGSNITVRGTVTSQASSESRLQQGSYKPGCPGKLLWLHLNLDYNKGHINLVVLGNSSGAVGSNITVRGTVTPVFQNNSKQGASKRKAVDRPIEHENSKRTAGLVVDLTGGERSQEILTLTSSGSQDQEAAHLIQENEKLRAQCSECEKREEELHSKVNKLRKELKEAQRTYAHMLVESRLLDKVKPEEDVYI

SEQ ID NO: 545 - protein, 670 aa, Phaseolus vulgaris
MGPTEIVDLSSDDESETVCLKAVKLEGDFVMDKKCQSHTTGQDSEENLSSNGPSTGHSNSSVLEQGPSPVDDTCISYVSPIGAAPLCRQFWKAGNYDDGIGSKVTVQNAKNYLHVHPMFLHSNATSHKWAFGAIAELLDNAVDEIQNGATFVIVDKTSNPRDGSPALLIQDDGGGMDPEAMRRCMSFGFSDKKSQFAIGRYGNGFKTSTMRLGADVIVFSCHLNNRILTQSIGLLSYTYLTQTQLDRIVVPMVNYEFNTSTGSLEVLNGNDHFVSNLSLLLRWSPYSSEADLLKQFDEIGSHGTKVIIYNLWCNDDGNLELDFDTNSKDIRIAGDVKRIDTLKAWKSVNEDHIANRFRYSLHVYLSILYLKIPERFQIILRGQVVKPHNIADDLKYPQFVKYAPLIGGSTKGTALTVTTIGFLKEAPQVNIHGFNVYHKNRLILPFWQVVNYLDSRGRGVVGILQADFIEPTHNKQDFERTSLFQKLEVRLKEMTWEYWDTHCTLFGYKKEKRKFTPGVTSMQNPLTIEKPVILNKSSSSLVNAKAYGNSLQCSKNLQSLDQGSQSKRKKTHELVDLMNTQEHASTDNVACVGFSQNKQTMATPADQVGDQKNLHLIHQNKQLHAKCLEFEKTGEELNLKVVKLKSKIQEAQDEYKRLLAEIKSLDVKEE

SEQ ID NO: 546 - protein, 709 aa, Vitis vinifera
MSFPDIVDLCSDDEHVEVDVKPVKLEPNIIEREIQLFKCHEILQAQYQLSKTHCRTQESEENRDSNALSTAQSSTSILDQGQSPMDDTSLSSTSPICPAPLCRQFWKAGNYDDELGSKVTLQNGKNYLHVHPMFLHSNATSHKWAFGAIAELLDNAVDEIQNGATFVIVDKTSNPRDGSPALLIQDDGGGMGPEAMRCCMSFGFSDKKSKSAIGQYGNGFKTSSMRLGADVIVFSRHLDNGKLTQSAGLLSYSFLRQTGHDRIVVPMVDYEFNTSTSNMEPLHRYGKKHFTSNLSILLRWSPYSTEQELLKQFDDIGYHGTKVVIYNLWFSDDGNVELDFDSDPEDIRIGGDIKQVTTIPAWKTINEQHIANRFHISLRVYLSILYLRIPQNFNIILRGKVVEHHNIANDLKFPEFILYRPQTGGLVEGTVVTTIGFLKEAPQVNIHGFNVYHKNRLILPFWQVVNYSDSRGRGVVGVLEANFIEPIHNKQDFERTSLFQKLEGRLKEMTWEYWDYHCGLIGYQVKKKPRTLVSPHISSHGSPHIAMEKPIGLNQSSPAIGNIKATPPGGAFQHPAATASHCLAGRPGEPITDSQSRSQQGASLKRTEHDHPVEPEKKKHAGIKEIVTDTHSQETQPVDIFANHSKDQEAMTLMQENKKLHAQCLEYEKREKELSVKMIQLRNELREVHNEQARLLAELQHLDAIKDEK

SEQ ID NO: 547 - protein, 692 aa, Theobroma cacao
MNCVEIVDLSSDDELGEVDVKPVKLEPGTVVGSTTKQKNNHRFQPVELVKYKTQSGKQASEENKSSNNALSTGQSSTSFLEQGQSPGDDTGVSSTSAVSPAPVCRQFWKAGSYEGGLGSKVTLQNSKNYLHVHPLFLHSNATSHKWAFGAIAELLDNAIDEIQNGATFVIVDKTSNPRDGSPALLIQDDGGGMDPEAMRRCMSFGFSDKKSKSAIGQYGNGFKTSSMRLGGDVIVFSRHLDNRSLTQSIGLLSYTFLTRTGHDRIVVPMVDYELNVSTGMLDVLHGREHFVSNLSILLQWSPYSTEAELLKQFDDIGSHGTKIIIYNLWLNNDRDSELDFDSDPKDIRISGDTKKVNTIPAWKAVNEQHIASRYHISLRVYLSILYLRIPDTFRIILRGEIVEHHNIADDLKFIEYILYRPQSFGSVEGTVVCTIGFLKEAPQVNIHGFCVYHKNRLILPFWQVVSYSDSRGRGVVGVLEANFVEPTHNKQDFERTSLFQKLEGRLKEMTWEYWDYHCGLIGYQVKKKSRPAASHVSSHFTGQSSAEQPVLLNQTSLDADRAKTGCTDVGVKQSITNSHGRSMQGLPTKRKEPGDLANLEKVKRQAGTSANTVVQPVDTTANHSKDQETIYLMQENKKLRAKCSEYEKRREELNIKVEKLRSEVGEVQREYYRLLAELNSLDIVKDENDVYM

SEQ ID NO: 548 - protein, 664 aa, Triticum urarte
MRSGGAAEVIDLSSDDDGESLPFPSTSAVTVAPSSTRDAKPYELADVKPLLYPIQHPGCYALVPVKDEDPVPLPLAAKAPRVLPPPRLCRQFWKSGEYVVARRNPDADAPGGRNRLRINPKFLHSNATSHKWAFGVLTSLIFAAIAELLDNAIDEVNNGATFVRVNKFTNPRDGSPSLLVQDDGGGMDPDALRCCMSFGFSDKQSDAFIGQYGNGFKTSTMRLGADVIVFTQNQKNWTPTRSIGLLSYTFLMETGCDDVLVPTVDYQYDLTTASYTQLLRHNQKLFSSNLAILSKWSPFASEAELLKQFDDIGEHGTKIIVFNLWFNDDGDMELDFNSDKKAYASILYLRVPDSFRIILRGQDVEPHNVVNDLLYRECVLYKPQIAGLPELSIVTTIGFVKGAPDTDVQGFNVYHKNRLITPFWKVASNSYGKGRGVVGILDASFIKPTHDKQDFEKSVLHQRLENRLKEMTYEYWGLHCHRLGYDNKSLPKASRALYRAKQTGAGSSPASVPHQLLTADIPTSSCVQSSMGQKRNFDALGVISDINNHQTKARETSSMGIYLFCLHRDVIQRKRFHEYKTLTLENDKLRDECLQYEESEKQLVEKKSTILVKFSHIIFNLLIEIMVYFTIVKEQKLRYQIAKETKKYEELLEELKLLDVKLET

SEQ ID NO: 549 - protein, 688 aa, Glycine max
MGPTEVVYLSSDDESEKEVAFKAVKLEEDFVLDAKQYNETNKGQLAKHKRSQSHTTGQDSEENLSSNGPSTGHSNSSVLEQGPSPVDDTGISYASSIGVAPLCRQFWKAGNYDDGLGSKVTVQNAKNYLHVHPMFLHSNATSHKWAFGAIAELLDNAVDEIQNGATFVIVDKTSNPRDGNPALLIQDDGGGMDPDAMRRCMSFGFSDKKSQFAIGRYGNGFKTSSMRLGADVIVFSCHLNNRILTQSIGLLSYTYLIKTQLDRIVVPMVNYEFDTSTGSLKILNGNEHFVSNLSLLLRWSPYSSEADLLKQFDDIGSHGTKVIIYNLWCNDDANLELDFDTDPTDIRIAGDVKQIDTLKAWKSVNEEHIANRLRYSLHVYMSILYLKIPESFQMILRGQVVKPHNIADDLKFPQFVKYAPVIGGSVKGTALTVTTIGFLKEAPQVNIHGFNVYHKNRLILPFWQVVSYLDSRGRGVVGILQADFIEPTHNKQDFERTSLFQKLEGRLKEMTWEYWDTHCTLFGYKDKDKKKLPPRVTSMQKPLAIEKPVMLNRSCSPVVNTKIEYGNSEQCSTKLQIRSEQGSHNKRKTHELVDLQNTEKHARTENVTCVGFSQNKQIIATPADQVFDRKTMHLVQQNKKLHAKCLEFEKTGEELNLKVTMLKSEIQEAQDEYKRLLAEVKSLDLKEE

SEQ ID NO: 550 - protein, 682 aa, Oriza sativa
MRSTAAAADVIDLSSDDDDEVPVPSTSAAAAAAARRVAPSTSPRDVTPYALVDVKPALLYPLQPPGVVVGGSGALVPVKEELPVLTPVPLLAAGYSPSTPSTKVALPAPRLCRQFWKSGDYVVAQRNPDADAPGGRNRLRINPRFLHSNATSHKWAFGAIAELLDNAIDEVNTGATFVRVNEFTNPRDGSSSLLIQDDGGGMDPEALRRCMSFGFSDKQSDALIGQYGNGFKTSTMRLGADVIVFTQNQNNWVPTRSIGLLSYTFLMETGCDDVLVPTVDYQYDISTASYTQMLRHDQKLFSSNLAILLKWSPFASEAELLKQFDDIGEHGTKIIVFNLWFNDDGDMELDFNSDKKDILITGAHRKVNTNKADKVATQNYVSTRLRYSLRAYTSVLYLHIPDNFRIVLRGHDVESHNVINDLMYPECVLYKPQIAGLAELSAITTIGFVKGAPEIDVQGFNVYHKNRLIAPFWKVANNSYGKGRGVVGILEANFIKPTHDKQDFEKSVLYQRLESRLKEMTYEYWDLHCHRIGYDNKKLPKSSRALNRANQMNAGSSPPIVPRQLLAADIPTSSCAVPTFMAPALRQKQMGLKRNIDALGSKTDSADQDGSHLDVSQRRRFNEYRTLTLENDKLRGECLQYEESAKQLALKEQKLRSQIALERKKYEELLQELRSLDVKTEK

SEQ ID NO: 551 - protein, 648 aa, Oriza sativa
MRSTAAAADVIDLSSDDDDEVPVPSTSAAAAAAARRVAPSTSPRDVTPYALVDVKPALLYPLQPPGVVVGGSGALVPVKEELPLLTPVPLLAAGYSPSTPSTKVALPAPRLCRQFWKSGDYVVAQRNPDADAPGGRNRLRINPRFLHSNATSHKWAFGAIAELLDNAIDEVNTGATFVRVNEFTNPRDGSSSLLIQDDGGGMDPEALRRCMSFGFSDKQSDALIGQYGNGFKTSTMRLGADVIVFTQNQNNWVPTRSIGLLSYTFLMETGCDDVLVPTVDYQYDISTASYTQMLRHDQKLFSSNLAILLKWSPFASEAELLKQFDDIGEHGTKIIVFNLWFNDDGDMELDFNSDKKAYTSVLYLHIPDNFRIVLRGHDVESHNVINDLMYPECVLYKPQIAGLAELSAITTIGFVKGAPEIDVQGFNVYHKNRLIAPFWKVANNSYGKGRGVVGILEANFIKPTHDKQDFEKSVLYQRLESRLKEMTYEYWDLHCHRIGYDNKKLPKSSRALNRANQMNAGSSPPIVPRQLLAADIPTSSCAVPTFMAPALRQKQMGLKRNIDALGSKTDSADQDGSHLDVSQRRRFNEYRTLTLENDKLRGECLQYEESAKQLALKEQKLRSQIALERKKYEELLQELRSLDVKTEK

SEQ ID NO: 552 - protein, 750 aa, Zea mays
MCMSSLIAPTRPRRLSFENSKRLEEASTDYMDAERDIKPFVFPTVPTTIQRNFHGPGARQPTARPLERCGTRVLPQTHRPCSAPRLSRKFWGAGDYDAVAGRSAPQPPSLQNRMCVHPEFLHSNATSHKWPFGVCLTFFPIAIAVAELLDNAVDEIETGGATTILLDKLIDKRNGSPALLIQDDGGGMDPDSLRRCMSFGFSEKQSGSSIGQYGNGFKTSTMRLGADAIVFSRCCTRSSGPTQSIGLLSYTFLVETGHTNVVVPMRLERHGSKQFFSNLSALLKWSPFATEEELMQNFCDIGPHGTKIIVFNLWSNDDGNLELDFDTNPEDIMISGAPNPEQISNSVRRANENHLANRLRYSLRVYASVLYLQLPDYFRIMLRGREVERHHIASDLIYPERISYRPQSCGIIREAEVLTTIGFLKGAPTISVHGFNIYHKNRLILPFHRVLSTASSKGRSVSGVLEVDFIKPTHDKQDFEKSQLFQRLMNRLKEMTNEYCTDAYFASNVTTQMSRSFHRDLYSNKIGYVKVPRVRAAPTPAPPVMLAIENGPAEPSERSAPAPTQPLRWQHGNSSCVNAVPIAMAPPAFHPAPVKTETDAPGAPTGYAYSYSPSWPSVQAMQIEKIKEEPSMAAPGTDWVETRKRTNDDGATTVALFKRRKAPQELAGSGSRSATDQVSRYVGEGELNEFCFLKMENRMLRGECSEFEMAEKELRVKEQNLRLEIEMAQEQFKRLLGEYVSFSSMPTRKP

SEQ ID NO: 553 - protein, 676 aa, Sorghum bicolor
MSLGAEVIELSSDEEEEPVPSTTALARHAPSSPPDVKPHLFADVDVKPLLLPPPLHPPGYGALVPVKTEEPVPVPVATVSPPPRALPPPRLCRQFWKSGDYVVARRNPDADVPGGRNRLRINPKFLHSNATSHKWAFGAIAELLDNAIDEVNNGATFVRVNKFKNPRDGNPSLLVQDDGGGMDPEALRRCMSFGFSDKQSDAFIGQYGNGFKTSTMRLGADVIVFTQNQNNWVPTRSIGLLSYTFLMETGCDDVLVPTVDYQYDPTTTSYVQMLRHDQKLFSSNLAILLKWSPFASEAELLKQFDDMGDHGTKIIVFNLWFNDDGDMELDFNSDKKDILITGAHKMVKTNNPEKIAAQKYVSTRLRFSLRAYASILYLHVPDTFRIILRGRDVEPHNIVNDLMYRECVLYKPQLAGLTESSVITTIGFVKGAPDIDVQGFNVYHKNRLISPFWKVANNSYGKGRGVVGILEANFIKPTHDKQDFEKSVLYQRLEIRLKEMTYEYWDLHCHRVGYDNKKLPKAIRAVNRANHMNGGSSPISAPPRLLAADIPTSSCGIPRLSASAAREKINSLDSLSKSPMGLKRKFNSFSAMAGSADQDGLDHMDKVDVSQRKRFNEYKTLTLENDKLRNECLQYEESEKQLVLKEQKLRSEIAEAEKKYQELLVELRSLDVKKEK

SEQ ID NO: 554 - protein, 740 aa, Arabidopsis thaliana
MRSYNLFHESNPTISFSFVGAETMAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 555 - protein, 783 aa, Solanum lycopersicum
MAPNSKSRVTKAFEAMKVFGYSETVVKPVLRNLLNLYNKNWKLIEDENYSVLLESIIDSEESKEKQKSSMEDEPEENEPPLKRSRLYSQGNHSSAAKHDAGPSVDTCTSELQPYGKQKMADITTESCETQDVEMKPRFLLNHHQRKGKKQISSEASPVSEEDNDIVVLSDDDKQETRILSSHLKLKKRGDTSRLYSAVKPKRRLAYSSSLEEPNVMGSTDVSKEGALVEYSFSDAMPLSDTLPGFDVPLAVVPSDLERLNSEHLGTEGNKEDATNSSRLNIASTPNGEVKLSFVYKIYSSSDFCPPSLDAVFKRMEEKYMKSYRFSQPGFLLSLMENLCKCYLTAGTRTRTANEPSAGIWSQKLHPVGVRYDATNHELHFAPDTSNGSFKLSNLIKILPQIPTFTASGNRDIMCYMVDFNGTRINGAEKDNTNKLLKLLASSTMNNSVLVQSEHSSPGLRNSVYYIEDISNGQEEHKISLINAFSHVLPVFKYIPKNVIFQNAYVKFLLARISDDSCCSNCSGDCLSQDIPCACAGETGGEFAYTSGGLLKEKFLESCISMSCEPQKHGLVYCQDCPLERSKNNSVSGLCKGHLVRKFIKECWHKCGCSRGCGNRVIQRGIAVPLQVFMTADGKGWGLRALEDLPRGAFVCEYVGEIVTNTELYERNTQTASERHTYPVLLDADWGSEGVLKDEEALCLDATYYGNIARFINHRCYEGNLIEIPVEVETPDHHYYHIAFFTTRKVNALEELTWDYGIDFTDHTHPVKAFKCCCGSKSCRDTGL

SEQ ID NO: 556 - protein, 865 aa, Solanum tuberosum
MPVNPRVKKAFRAMKSIGISEEKVKPILKSLLKLYDKNWELIEEENYRALADAIFEKEDSEVAEHKKPENNEVRDMPLVQREEVLEEEAVPEEPERPLKRLRLRYQEGQASPSSNNSSAGTSLKRPRREEEGELSGPRYQNQSQGEANPSSVRKNLRLNETQTSPIASRGQNSVAAKSSHAVKLKEPKTEPGVELSSKQKMSGSLALIKPKDEPYTDDMPQFEVPIAVIHPELSNKGDTSSGNTSRRHSETPELLAIELRGGRDSSEEITTSLNGVKTSRELIEVQDRCHTDVDIASSPSGEVKISINWDPALCRSSDFHTPSVESVMKMVELKCLKSYKILDPNFSLMKLMKDMCECVLELGTQHSPELQSTTDVAAENDFGSRSMTVNSSNGFMNFEIDAGDAQPKIPRPSPPRIGEDYIQAGQIASMGNCGSTPETDQNGIEQTNPWSMEAPCELILGEIGTFDSLNELLNSDLGAGEAQPEIPHLNSYFGEDSTQADHTASMGNCGIAPETSQSRLEEVVSHEATPRDVGSVEVIDITKGQENVIISLVNEVNSNHPPSFHYIASNVVFQNAYVNFSLARIGDDNSCSTCSGDCLSLSTPCACAHITGGDFAYTKEGLIKEEFLKECISMNRDPKKHCQFFCKECPLERSKNEDIIEACKGHLMRNFIKECWWKCGCSKQCGNRVVQRGISHKLQVFMTPEGKGWGLRTLEDLPRGAFVCEYVGEVLTNTELFDRVSRSPNGEEHSYPALLDADWGSEGVLKDEEALCLDATFYGNVARFINHRCFDSNLVEIPVEIETPDHHYYHLAFFTTRKIKAMEELTWDYGIDFDDLEHPVKAFSCHCSSKFCRNMKRPSRSRSRR

SEQ ID NO: 557 - protein, 824 aa, Phaseolus vulgaris
MAPNKRVVAAYRAMGSLGIDESKVKSALKKLLKVFDKNWELIEAENYRVLADAIFEEDDNTVPKLKKKIQSDDVHSTCHSLPSFSNNQEDETESEEAQMHNERAQPLKRLRLRDQESQPLHPLTNSATSPPSKRPKLEDNALHQGSFGKKPQNKPESSDGNPRIEAPSLRLPDDIVDKGKQPASTQVLQRGRKLTSGRSSPSTPSKEPTVESGKFLLPNNMMPRTQALIIPKDEPIDEVPDYEMPIAVIPPEPSSVRDSSLKNGVAGKHVSHVTVTSSECRDGVRDEDASPTSNEEATCNVEIASSTLGEVKLSLSCSSALWGSKFHMPRRDEIIEMMEEKCLFSYKIADPNFSVMKLLRDLCDCMLEFGNNSNNDPEESSILRSNVDVSKESQEPGTLDVVRNKDLDMLSDVSNGPINVSPSAAVASPQSFLLLADLNGVNDAVLDSKMDQTTNDFSQCNVRKELECPISPNSHSLVIVPQDQLTADDIRSFYDISDLTKGEENVEIPWVNEYTNDFPPSFNYIPQNLVFQDAYVNISLSRVGSEDCCSTCAGNCVLSIPCACANKTGGEFAYGSRGLLKEQFLNSCIAISRNPQKHFFYCKNCPLDRIKNDGGLEPCKGHLKRKFIKECWSKCGCGKHCGNRVIQRGMTCKLQVFFTSEGKGWGLRTLEDLPKGAFVCEFVGEILSIKELYERNMKCTGEGKHTYPVLLDANWDSGHVNNKEALCLDAASFGNIARFINHRCFDANLVEIPVEVEDPGHYYYHFAFFTSRKISAHEELTWDYGIDFDDHDHPLKLFQCSCGSKFCRHMKRSNRSNISASISE

SEQ ID NO: 558 - protein, 848 aa, Vitis vinifera
MARNPRVLAAYRAMRALGIAEATVKPVLKNLLRLYEKNWELIEEENYRALADAIFEYEETKQDNILGGETQLHDEPARPLKRLRLRNQESQVSPSLANSSQTLGGAVMKRPKLEDAEQPQTLAERQPQGIAETPEPSVGNIRPELHPVSSPQAHLVNKGKQPALPQPLAVQGRSDLSPTSATKRAESDLLHTQQRLRDKGKEPLSPQIAAKEKRSIPVRSFHLNAEPGIILSPKQKVHDTPALMKPKDEPFTDDILQLEVPIAVIHPDPLHKGNLPENYSTGKLDGPQPPVNSRVDGEDEVNGGPASSSGAGTNCELANISNLEIASSPLGEVKISLSCNSALGKPDFRMPSLDTLLKLVEDKCLRSYKIIDPNFSVTKLMRDMCDCFLELGTHTEESHEGSINTTPTGDLLGKSTAPDAVGSCGDEENFSMSSCITNGSFKIQCSTEVAVPQIPRLLSSSLNGLGDHIQLDSKITENSCRENGQEKETNGPNNANSLSLVVVQQRQLTPDDIRFIHDVDDITKGEEKVRIPLVNETNSEFPTPFHYISQNLVFQNAYMNLSLARIGIENCCSTCFGDCLSSSTPCACACESGGDFAYTLEGLVKEDFLEECISRNRDPQQHQLAFCQECPLERSKAEDILEPCKGHIVRKFIKECWSKCGCSKQCRNRLVQRGITCNFQVFLTPDGKGWGLRTLEDLPKGSFVCEYVGEILTTVELYERNMQSTSRGKQTYPVLLDADWALRGILKDEEALCLDATFYGNVARFINHRCLDANLVEIPVEVESPDHHYYHLALFTTRKVNALEELTWDYGIDFDDQDHPVKTFRCCCGSKFCRNMKRTRSRSALSLG

SEQ ID NO: 559 - protein, 811 aa, Theobroma cacao
MAPNPRVVQAFRSMKEIGITEEKVKPVLKKLLKVYDKNWELIAAENYRVLADAIFEEEDNKVSEPKKGQKCDEEEDTMEEGAVPDELVRPLKRIRLKNQEGLASSSHNNGSTDVAGPFLKKPKVEEDELPPASLRQQSLQCNVGNMTECLPASPGCVSLQPTAPGPVSPHQGGRNKGKQPVAPMPLAVLEGYDQNLHSTQMHVSYKGKEPMSPHVTYNEKGPERVSLALCIKDPAPCPGIITKKRMPDTHALIIPKEEPFTDDMPQDEVPIAVIHPDSLSRRDSPIGHVSTGKSNWQEHPESLFADENVGAGASASMSERHISCELATVPDEIPSSLEIASSPLGEVKISLSYNSALGRSNFQLPSIDELRELMEQRCLRSYKLIDPTFDVIKILNDMCECISELATNSSNQSQEGNVMPALDLLKKSPARDALDAESNKENGCLPAKMLNGALDVQCSSNGCVDNVEGKELVVVQQHQLTSNELRWLHDASDITKGEEKVEISWVNEINKDFPPPFHYISENLVFQNAYVKFSLSRIGDESCCPTCFGDCLLSEQPCACACQAGGKFVYTSAGVVREDFLEECISMTRDPQRQCFLNCTECPLERSKKDDFPEPCKGHLKRKVIKECWSKCGCNKQCGNRVVHRGVNYKLQVFLTPDGKGWGLRTLEKLPKGAFICEFVGEILTISELYARNTEKHTCPILLDAYWGLKGVSKDEEALCLDATGYGNVARFINHRCLDANLIEIPVEVETPDLHYYHLAFFTTREIDALEELTWVSEWDYGIDFDDLDHPVKAFRCRCGSKFCRNMKRST

SEQ ID NO: 560 - protein, 761 aa, Triticum urarte
MGSSRGNRNVRARRAVKAMKLLGISREQTAPVLRRLVELYDDNWQLIEAESYRALADAIFDEQANGGPANGGDQVQGQEELDLELEETGTMPEMFTPEDDDQRPSTSLAVVRKDPDNRITAPRSRTGSRANLLGSDPTQAASPTQTRALSKQRQMQMQMMDEDFQQPVFLREPKPEPVDMDAVDCLNVQPGLIHRSRKRSAPSSEFLALPPPEQTPKQISEGDKNRTTQHCRNREMPTLSVEPANSTMNNGTGSGDGNVQEAPCLDIDIASSPRGDVKMSLKFCIDPSKFHMPALEAVLKMVEDKCLRSHKVLPPDFSIRGLMTEMCQCVVQLGTKHTAEHNTQSDTVGNGSLSENAINRKRKAREEPLVSKGSESGPANSTLAQQHHLALSVSKTIHDITDISKGEENVRISIADESGREKCPPSFYYMPTNAVSQNALISMFLAKIGSEDCCPECFGNCLSAPAPCACARQTGGEYAYTPDGLVKPAFIDECVSMNRFPEEHHRVYCKTCPLERSKNKASPEPCRGHLVRKFIKECWSKCGCNMQCGNRVVQRGIRCNLQVFFTEEGRGWGLRTLDDLPKGTFVCEYAGEILTNTELHERAIQNMQNARYTHPILLDAGWCSGGEPKDEEALCLDGTFYGNVGRFINHRCCDANLAMIPVEVETPDHQYYHVAFFTSKKVEAFEELTWHVCNLCSYRQMSQRARLPKPMYLQRLTNLMDYGIDFDDERQPMKAFECLCGSRYCRGGKERRRSRVTGTAG

SEQ ID NO: 561 - protein, 857 aa, Glycine max
MAPTPSQKERALAACRAMSSLGIDDSKVKSVLKKLLKVYDKNWELIEAENYRVLADAIFEDDDNMEAETGCEEAQMHVETPQPLKRLRLQGQESQPLHPPPNGSPSPSSKKLKLDDNASGKKPQNKPVSSDGNPGIATRPLPPRDGIVDKGKQPASLPLNHRGRRLPSERVPQSIPSREPTVEPGRFLLPNNQMPRTQTLVIPKDEPIDELTDYEMPIAVIPPESSVRNSSIKNGVAGKHSGHVTVTSSQNRDGVGDEDVIPTSKKEATCNVEIASSTLGEVKLSLSYGSALQGSDFHIPSRDQLIKVMEDKCLRSYKITDPNFSVKNLLRDICDCMLEFRNDSNDDSQEGSVISSSVDVSKEPRAPGTLSVVGNKDLDTSSHFSNGSINVKSSDDLVSPGSILPLAHPNGLSDAVPVSKMDRTNDFLQSNVKKDLEDPMSPNSHSLVVVPQHQLTADDIRSFHDANDLTKGEENVEIPWVNETTNDFAPSFNYIPQNLVFQEAYVNISLSRVGSEDCCSTCMGNCVLSSSCACANKTGGEFAYNAQGLLKEEFLEECIAISRNPQQHLFYCKNCPLERSKSDGCLEPCKGHLKRKFIKECWSKCGCGKQCGNRVIQRGITCHLQVFFTSEGKGWGLRTLEDLPKGAFVCEFVGEILSMKELHERNLKCTENGKYTCPVLLDANWDSGYVKDEEALCLDAASFGNTARFINHRCSDANLIEIPVEVEDPGHYYYHFAFFTSRKISAQEELTWDYGIDFDDHDHPVKLFQCRCGSKFCRNMKRYSSKFNLQLLGHHHKPTMIVMKYRAPLQYWSGVLLIDAIIFHHISFSSHWIAWLIVGKALDLLDMRQLQDDSLSP

SEQ ID NO: 562 - protein, 741 aa, Oriza sativa
MAKPNGKEKTGDTGLSMAPPKISKDRFDAAIRAMADIGILKETAAPVLNNLLNLFDYNWVHIEADNYLALADAIFCDSDPKEGQKRQANETNLDADQSNKKLKTKKRSQNPTSKMHGNDNREFVEAPPQQGRGTLSARTVNGKKVTRAHLELPSSQLLIKEPHTCPSIAKNTTIVENNSAVLCHGQDLQTFEVPVATTCPQVVAPSTRKDARRTSGARHDQKHEGVSGAHERNRAVACSNQEIVSSKDSPSNIEVVLSNYGAGKLSFTYNSSLANRSDFHLPDIKLICKKMEARCLRKYKSLEPNFSFKNLIKDTCQCIVESSGPRHEGIIQTVPALDILSKPSVPQILQSNQANSAFMPPNNVMSLGGTSSSCTVAGVSQNSSNMPVVPHQLHIGANRPPHDVNDITKGEERLRIPIINEYGNGILPPPFHYIPHNITLQEAYVNISLARIGDDNCCSDCFRDCLAQSLPCACAAETGGEFAYTTDGLLKGAFLDSCISMIREPLKHPHFYCKICPNERMKIEVNSDSSNTEMNPGPCKGHLTRKFIKECWRKCGCTRNCGNRVVQRGITRHLQVFLTPEKKGWGLRSTEKLPRGAFVCEYVGEILTNIELYDRTIQKTGKAKHTYPLLLDADWGTEGVLKDEEALCLDATFYGNVARFINHRCFDANIIGIPVEIETPDHHYYHLAFFTTRIIEPFEELTWDYGIDFDDVDHPVKAFKCHCGSEFCRDKTRRSKSRARV

SEQ ID NO: 563 - protein, 736 aa, Oriza sativa
MGSKSNTERARKALEAMKQLGFSKKEATPVLKNLLRLFGNNWEPIEDECYRALADAILDRHQETAADRGCSATRPTPDDDHHPLTLCGASRDVDTETDEPRTKKPRATNSDPQSPPSLTDDQDVPAAISPPSHGASPQFRPQTRASARLRQASPSSVTAAHKRPRQMMDEDFQDSAFLREPKPEPDIDMDAIQGTAATSDCPNAHLGLIDYPLNASSSRVALPLALLPPDQNVPQISGPKKRAIQPCSKVNTGEGSSVIDVASSTMGEVKMSLKCSVDPKFRMPSLEAVFKMVEDKYLHSYKILPPEFSIGSLMNEICQCVVQLGSDHIAEHNTESDVAGNGRCSQNEPMTGSIPFVKPIACEDGGNRKCKSAGESFIVEDSENSSVAKQKTHLALANLKPIHDVTDISKGEERVRISVANEFASEKCPPSFYYIRGNLVFQNAYVNISVARIGDEDCCADCFGNCLSAPIPCACTRETGGEYVYTPEGLVRTPFLDECVSMNRFPEKCHKFFCKSSCPLERSRNEASPEPCRGHLARKFIKECWSKCGCNMQCGNRVVQRGITCNLQVFFTGEGKGWGLRTLDELPKGAFVCEYVGEVLTSTELHERTLQNMNNGRHTYPVLLDADWGSEGVLKDEEALSLDSTFYGNVGRFINHRCYDANLVEIPVEVETPDHHYYHLAFFTTKKVEAFEELTWDYGIDFGDGKDPVKAFQCLCGSRYCRGIRHPRKRGKAAAK

SEQ ID NO: 564 - protein, 720 aa, Zea mays
MGSNTERARKALGAMKLIGFSKKQAIPVLKELLKIFNNNWEPIEDESYRALADAILDRQDSKQTPPSQQGTQAAHADLEPLRSTRDDRQQYLSASLDDTCEDDNETPLVKRPRMGTANFRPELQPPQQSSVSTQGALPASPQTSRRQTRSLTVEPHAAGHEYPLAVNDALVVKEPKPEPQIDRAEDFVAGPNATQLNDGSSEQTSGFGARGNIVHQAQSLGRSLQAAAVCKNGVGSTVQNTHETSIVEVDVASSANGEVKMSLKCSLGSSNFSISMEEVFKMVEEKCLHSYKMLPSDLSIGKLLSEVCQSVVQLGTMHSEVNRDSGSLHNEVVVPFVKPISCEAAVGISDDVAGGSSVLESSEPCLQNSLVAWNPELAHCNQKTTHDTTDISKGEERVRIPVVNEFGSETCPPSFYYIPRNLVFQNAYVNISISRICDEDCCADCSGNCLSAPVPCSCARITGGEFSYTLEGLLKTAFLDECTSVNHFLQEHHRFYCPVCPLERSKNEGSPGPCKGHIVRKFIKECWSKCGCGMQCGNRVIQRGITCKLQVFFTREGKGWGVRTVEDLPRGAFVCEYVGEILTSAELHERAIENARNGKHMHQVLLDAGWGSGVVLRDEDACSLDGSFYGNVGRFINHRCYNANLVQIPVEVETPDHHYHHLAFFTNKKVEAFEELTWDYGIDFDDMEGPSKPFRCMCGSRYCRDPNNPRRMGRAAAKRK

SEQ ID NO: 565 - protein, 739 aa, Sorghum bicolor
MGGKNMERARKALDAMKELGISRKQATPVLKELLATFDNNWEPIEDEHYRALADAIFAREDNKQTSPSQQGAQAAHVDSEPNGSTWDNRQQYFSATHDDTGEDDNETPLVKRPRMGTANFRSEPQPFEPGPQQSTVSTQGALPASPQASRRQSRSLAVVPHAAGHEYPLAVDDALIVKEPKPEPQIDISEVSVGDPLTDRDFLAGPDAIRLDDGSSGSGARGCIVNQPQSLGRSLQPAPVCENGVQSTVQNTQETSFVEVDVASSTNGEVKMSLKCSLDSSNFSISMEEVFKMVEEKCLHSYKVLPPDFSIGKLMSEVCQSVVQLGTVHSEINRDSGSLHNEAVAPFVKPIACEASVGINGNVAGGSSVLETSEPCLQNSLVAWDPELAHRKQKTTHDITDISKGGERVRIPVVNEFGSETCPPSFYYVPRNLIFQNAYVNFSIARIGDEDCCADCSGNCLSASVPCACSRLTGGEFPYTPEGLLKPAFLDECTSVNHFPKEHHRFYCTVCPLERSKNEASPGACKGHLVRKFIKECWSKCGCGMQCGNRVIQRGITCKLQVFFTREGKGWGVRTVEDLPKGAFVCEYVGEILTSAELHERAIENARNGKHMHQVLLDAGWGSGVSRDDEGSGVLRDEEALSLDGSFYGNVGRFINHRCYDPNLVQIPVEIETPDHHYYHLAFFTNKKVEAFEELTWDYGIDFDDVEGPSKPFRCMCGSRYCRDPNNTRRMGRAASKRK

SEQ ID NO: 566 - protein, 888 aa, Arabidopsis thaliana
MGFVYIVMTGYYKNVHKRKQNQVDDGPEAKRVKSSAKVIDYSNPFAVSNMLEALDSGKFGSVSKELEEIADMRMDLVKRSIWLYPSLAYTVFEAEKTMDNQQVVEGVINLDDDDDDDTDVEKKALCVVPSSSEIVLLDSDDEDNERQRPMYQFQSTLVQHQKNQGDVTPLIPQCSFEEVDLGRGKEMPSAIKAIVEGQTSRGKVLPIENGVVNEKGVYVGVEEDDSDNESEAADEDLGNIWNEMALSIECSKDVARETSHKEKADVVEDCEHSFILKDDMGYVCRVCGVIEKSILEIIDVQFTKAKRNTRTYASETRTKRFGESDNELKFSEEGLMIGGLAAHPTHAAEMKPHQIEGFQFLCSNLVADDPGGCIMAHAPGSGKTFMIISFMQSFLAKYPQAKPLVVLPKGILPTWKKEFVRWQVEDIPLLDFYSAKAENRAQQLSILKQWMEKKSILFLGYQQFSTIVCDDTTDSLSCQEILLKVPSILILDEGHTPRNEDTNLLQSLAQVQTPRKVVLSGTLYQNHVKEVFNILNLVRPKFLKLDTSKSAVKRILAYTPCDVRGRLTGSNSDMASMFNETVEHTLQKSEDFTVKIKVIQDLREMTKKVLHYYKGDFLDELPGLADFTVVLNLSPKQLNEVKKLRREKRKFKVSAVGSAIYLHPKLKVFSDKSDDVSDTTMDEMVEKLDLNEGVKAKFFLNLINLCDSAGEKLLVFSQYLIPLKFLERLAALAKGWKLGKEVFVLTGNTSSEQREWSMETFNSSPDAKIFFGSIKACGEGISLVGASRILILDVPLNPSVTRQAIGRAFRPGQKKMVHAYRLIAGSSPEEEDHNTCFKKEVISKMWFEWNEYCGYQNFEVETIDVDEAGDTFLESPALREDIRVLYKR

SEQ ID NO: 567 - protein, 1157 aa, Ricinus communis
MHYVEKKRLANQKTTSVPQCDVINLEDDPPQSHVIAADIPVIILDSDEEDNGYQKPSHMYSKNSSSEPAHKLSVTVSAVKDCHEVRASWDETRSAPANNDFLVDKRKNTDTKNDAQVKDTEKVKASRDFVGGSLAECNIHANESPYPGMKTDVQVGDSENVKNSASVIVDLLGKCKIQVDSNSYACMDNDIVIKEDSHQDDIEDDGLVTIDTDVNNFENDRSQGHVTAADIQVIIINSDEEDSGYQRHSYLYENGTLSGPAHKLPVKDLTVTDCQGVKDPKDEARHSPANYCFQVNKNEYTDTKNDIQVEDNENVKASKCDVGGSLAECNIRVDEIPHSGMESIVQVRNSKKVKDPCDVIGDSHGKCSIFADVNSYTSMKSTAAIKKENHQIGVEDDAIVENETENDIQIKDNKRDKASRITIGNSPTKCSTQVLYATMENHMVIKEDIHQINAKDNGLAKIDTEGDIQDMDSKEFKASRDTVEGSLDKCNIQVDKRPYAVMKISMAIKEDSQHISVEDNVLSKIDTEDDIQDTVGKRVKALSIKVDDSMYTDMENAMAIEEDNRQIDVEDDGLADIWKEMKFAIEYSKDFAVDPATYGCLEEDAEACDHSFVLKDDLGYVCRICGIIQRSIDTIFEFQYAKKRNMRTYAYEPKYTIGKEPIGGIPVGINSPDLMVTEIAAHPRHKKEMKPHQVEGFNFLCSNLVGDNPGGCILAHAPGSGKTFMIITFIQSFLAKYPNARPMVVLPKGILATWKKEFEKWQVENIPLHDFYTLKAENRSQQLDVLKRWVKERSILFLGYKQLSTIVCDSSKVAAECQDILLKVTLREMRRLMYFNPSQKFKPLFLKLKASRMIINRIMGRVQISRVRKHLKHGGDSAFFDSVEYTLQKDEDFKRKKAVIQDLRQMTSKVLHYYKGDFLDQFPGLVDFTVVLNLSARQKDEVQKLRKLDKFKRISLGSAVYMHPRLKDFSQVCFATREKGSNIDDRTIDALLGNLDVREGVKTKFFLNILRLCESAGEKLLVFSQYILPLKLLERLSAKVKGWSLGKELFMITGDSNTEQREICMEHFNDSPSAKVFFGSIKACGEGISLEDYLTCSRKELISKMWFEWNEHCGDQDFEVKTTDVNECGDMFFESPGLREDLNVLYKRKRRQRGTLK

SEQ ID NO: 568 - protein, 883 aa, Glycine max
MESADDVSASKRPLPTGFSPGPDGPKRLRLSSDSLPYPACDQIEPKTPKNPNVVDYSNPFAITDILDRLENGKFGSVTKDIEALIALKMQIMGPYFAKYPILVNQLLKVVTHHDEETPKLENQQVTGLTHQSVIDLEGEYTEKDVPAVPNTVVIIDSDEEDDRDKKSVIPFHEVVLPRKVAPSPALKVIGYHTYLGESNDLKIEINMADKGNNTRSNKGVYVGAQGEEEDKADTEDDGLQDIWKEMSMAIECSKDVSEDPEPEEEEEEDDNCDHSFVLKDDLGYVCRVCGVIDRKIETIFEFQYKVKRSTRTYASDSWNSKGKADVFGINVAEDDLVVTDIAAHPRHMKQMKPHQVEGFNFLVRNLAGDHPGGCILAHAPGSGKTFMIISFMQSFLGKYPNARPLVVLPKGILSTWKKEFQTWQVEDIPLYDLYTVKADSRSQQLEVLKQWMEQKSILFLGYKQFSSIVCDNGTNNTSLSCQEILLKIPTILILDEGHNPRNENTDMVQSLAKVQTARKVVLSGTLYQNHVREVFNILNLVRPKFLKMETSRPIVRRIHSRVHIPGVRSFYDLVENTLQKDTDFKRKIAVIQDLREMTSKVLHYYKGDFLDELPGLVDFTVVLTLSPRQKPEIQKLKKLSRRKFKINSVGSAVYLHPKLKPLAENCGENSTSDNIMDDLIEKLDMRDGVKSKFYYNMLNLCESAGEKLLVFSQYLLPLKYLERLTMKWKGWSLGREIFVISGESSSEQREWSMEKFNNSPDARVFFGSIKACGEGISLVGASRIIILDVHLNPSVTRQAIGRAFRPGQMKKVFVYRLVSADSPEEEDHNTCFKKELISKMWFEWNEYCGDRAFEVEAVEVKECGDLFLESPLLGEDVKALYKR

SEQ ID NO: 569 - protein, 950 aa, Zea mays
MSQSPGGREGIYYSRQRKPSERNGSVFTPIAAMYPSGHALPDANRNHSLVFGGTSKDWDNIRQFIASLERASENSSAIASKTGGGKSTNHSVEPAEQKGKGDIIVLDSDDEDGDGNSPEHNKLASEMNKELGTSVLASNIAERMATNGSQTFETVHAYGGSKNTQIVPYGQGSALVNQFPLQTSWQPSIQFERVVLTKRPEEQRMQDLVAATIAEKRAETQMFLSLPTERKRRRTDHSLLMLDSFVPKQRRRKGDTGLAPADLSLDLHQTATSQEPDIAIEEEEKRKNDGDGLEDYWKDFALAVESTKLDDVDEAAANEKEDNGKMEDIDCNHDIRIHEDLGHVCRVCGMIVRRADSIIDYQWKKASRRRMNGYGGNSKDADEIDCGTVKLSEDFIVADIAIHPRHAQAMKPHQVEGFNFLVKNLIGDKPGGCILAHAPGSGKTFLLISFIQSFMARYPSARPLVVLPKGILVIWKKEIQRWQVQDIPVYDFYSVKAEKRVEQLQILKSWEDKMGILFLGYKQFSTIVTDDGGSKVTAACRDRLLKVPNLLILDEGHTPRNKETDVLESLSRVETPRKVVLSGTLFQNHVEEVFNILNLVRPKFLRMESSRPIARRIMSQVEIFGRSSKGLADGAFTEAVEGTLLNDENFKRKVHVIRGLRELTRDVLHYYKGAILDELPGLVDFSVFLKLTPKQKDIVHKLEMHDRFKRSAVGSALYIHPCLSGLSEVNAENRAHTLRDDSVDSLMDSINVRDGVKANFFMNILSLANSAGEKVLAFSQYILPMTFFERLLVKKKGWHVGREIFMISGDTSQEDREAAVDRFNSSADAKVLFGSIRACGEGISIVGASRVVILDVHLNPSVTRQAIGRAFRPGQQKKVFVYRLVAADSDEVKVHETAFKKEVIQKLWFEWSEQCTTENFKLGQVDIDDSGDELLDTRAIRQDIKALYRR

SEQ ID NO: 570 - protein, 653 aa, Physcomitrella patens
MNEIDRAFCINTLTSWRTFCVQGKGEVNVEEVTESCEHVYEVKNDVGRACSQCGLIKVDIKDMTFMWRRPCSVRKAFVRGERLDNWNDSGDGVLEEDVRLVGMAQLEAHPSLENAMHPHQLEGFKFLSRNLVEEDSGGCMLAFAPGTGKSFLIISFIQSFMVQVPNARPMIVAPKSMLRPWMQEFKKWEVEEMLVLNLYEADDHVKMLKQWMATPSVLLVGYSQFINPSGEVGKYLTEGPGMIVMDEGHLARTEETKILKSLTRVHTRRRVLLSGTPFNNNFEEFYTTLELVRPNFMSRANAQMFPTLNTFQQIVDTKMNSKQPVLDGQLLKRSTNAGRKAFQDVIGEKFESGKYSNIAKALQQLRVLIEPFVAWHKGQILNSLPGITDLTIMLELTAQQLELVRKNKQNEVRDSLQKRAAAIYVHPILEPVADGVKRSQRDPRLKGDVDVKAGAKLRWVLDMVQQCNDAKEKLLIFSEYLYSLALIENMAVQRMKWSKGLQILRLDGSLPPQERERVQHKFNTDPEVRVLCASIKACGEGISLVGASRVILLEVLWNPSVPRQAISRAFRIGQQRKVVVYRLIAAGTYEEMNMHAAATRKEWLSRLLFDPTIPCDDPNSILWDVTKDCSDSFLAYKQSKLREGVRSIYQREF

SEQ ID NO: 571 - protein, 748 aa, Sorghum bicolor
MQDLVAASIAEKRAETQMFLSLPTEKKRKRSDLSLLMLDSFVPKQRRKSDTGLAAADLSLDLQQPAKSPEPEPEPDMAIEEEEKCKNESDGLEDYWKDFALAVESTKLDEVDEAANEKEDNGNMEDIDCNHDIRIHEDLGHVCRVCGMIVRRADSIIDYQWKKASRRKTNSYGGHSKDADEIDCGTVKLSEDFIIADVAIHPRHAQTMKPHQLEGFNFLVKNLIGDKPGGCILAHAPGSGKTFMLISFIQSFMARYPSARPLVVLPKGILGTWKKEIQRWQVQDIPLYDFYSVKAEKRVEQLQILKSWEDKMSILFLGYKQFATIVTDDGGSNVTAACRDRLLKVPNLLILDEGHTPRNRETDVLESLNRVETPRKVVLSGTLFQNHVEEVFNILNLVRPKFLRMESSRPIARRIMSQVEISGRGSKGFADSAFTEAVEGTLLNDENFKRKAHVIRGLRELTKDVLHYYKGDILDELPGLVDFSVFLKLTPKQKDIIRNKLESHDRFKRSAVGTALYIHPCLSQLSEVNAENRANTLRDDLVDSLLDSINVKDGVKANFFMNILSLANSAGEKVLAFSQYILPMKFFERLLVKMKGWHVGKEIFMISGDTSQEDREVAVDHFNNSADAKVLFGSIKACGEGISLVGASRVVILDVHLNPSVTRQAIGRAFRPGQQKKVFVYRLVAADSDEEKVHETAFKEVIPKLWFEWSEHCTTEDFKLGQVDIDDSGDELLDTKAIRQDIKALYRR

SEQ ID NO: 572 - protein, 872 aa, Oryza sativa
MDTPLEQKQKDSSAIIVLDSDDEDEAERCEQLASENNKQQAPSGPTSPCTTWIVSSAKDQVNGTLHVDGVQSTQIVPYGQNAPLINQSPLQTSWQPSIQYERVILQRRPEEQRVQDLVAASHAEKIAETQVFLTLPTLPNERKRRKSEPTTLVDGDGGTNLGKGKRKNHQNQAAVDSILDLQQTVVPLQQNDVPSQSYRTMIEEEKPVKESDGLEDLWKDFSLAAECTKLDTNEDMSNEKDVDDENEMDDDCNHDIRIHEDLGHVCRICGMIVRKAETIIDYQWKKASRTRTNYYESRSKDADDIDTGAVKVSEDFIVSDIAIHPRHAKQMRPHQLEGFSFLVKNLVGDKPGGCILAHAPGSGKTFMLISFIQSFLAKYPSARPLVVLPKGILGTWKREFQRWQVEDIPLYDFYSVKADKRTEQLEVLKSWEARMSILFLGYKQFSRIICGDGDGNIAAACRDRLLMVPNLLILDEGHTPRNRETDVLASLKRVQTPRKVVLSGTLFQNHVSEVFNILDLVRPKFLKMESSRPIARRIMSQVAISGIRSLKGVHDSAFTESVEDTLLNDDNFTRKSHVIRSLRELTKDVLHYYKGDILDELPGLVDFSVFLKLSTKQKEIVHKIEAYEKFKRSAVGTALYIHPCLSEISEGDAADRATNLTDATVDSLIESIIIKDGVKAKFFFNILSLANSAGEKLLAFSQYILPMKFLERLLVKRLGWHVGKEIFMISGDTSADDREVAMDQFNNSADAKVLFGSIKACGEGISLVGASRVIILDVHLNPSVTRQAIGRAFRPGQQKKVFVYRLVAADSPEVKFHETAFKKEVIPKLWFEWSELCTTEDFKLNQVDIDDSEDELLEANAIRQDIKALYRR

SEQ ID NO: 573 - protein, 984 aa, Brachypodium distachyon
MAAAGEDPQEPHSGDCERLPLHHHLLLSHLVVVSPSAPAVGSDLEFGLVEAGKGMYYRRKNRASDPISGLSLPAGSGVHSWGCGSVTKDMEDIYARNVQLINFLSTLHEPTRSSVPMVETNVKYCSIKQETKVTDCSVKQTEPILIPDSDDEDGSTAELAPEKNKELIPLGLAGTLTAHVTSKGKDQVNETRHYGYQNSQIVPYGQSAALINHHSLQTSWQPSIQYESVILQTRTEEERIKYLAAASHAEKMAETQVFPDLPRERKQRKLDPNSQVDGDAGTAPRKRKRKTGPDPAAVDLPSETYNPVEEEEPAEEDKPENKSDGLEDLWKDFSVAMESSKLNTFEELPDEKELGEKDVDNDCNHDIRIHEDLGHVCRVCGLIVRRADTIIDYQWKKASRSRSYFCGTRSKDADEIIIGDIRVSDDLLALDIAIHPRHKKQIRSHQLEGFHFLVKNLVSDKPGGCILAHAPGSGKTFMVISFIQSFLAKYPSGRPLVILPKGILGTWKKEFQQWQVEDIPLYDFYSVKAEKREDQLKILNSWQSKMSILFLGYKQFSTIICGDGGGTVAAACRDMLLMVPNLLILDEGHTPRNTATNVLESLSRVQTPRKVVLSGTLFQNHVGEVFNILNLVRPKFLRMESSRPIVRRIMSQVAISGTRVSKGVPDNVFTESVEETLLHDENFTRKAHIIRSLRELTNDVLHYYKGDILDELPGLVDFSVFLKLSPRQKEIVHKLEAYEKFKRSAVGTALYMHPCLSEMSEGDATDRANNLTDAAVDSMVQSINVRDGVKASFFINILRLASCAGEKLLAFSQYILPMKFLERLLVKTWGWHVGKEIFVISGDTSPEDRELAMDQFNNSADAKVLFGSIKACGEGISLVGASRVVVLDVHLNPSVTRQAIGRAFRPGQQKKVFVYRLVAADSAEESFHETAFKKEVIPKLWFEWSEQHCTTDDFKLNQTDIDVCGDELLDNQAMRQDIKALYRR

SEQ ID NO: 574 - protein, 859 aa, Populus trichocarpa
METPLNILPLKRAAPNESRFNGNKRMKQMKEKVTDYSDPFAIHGLLDRLDSGRYGSVTDDIRSLFNRKAQMIHTFLVMYPELANESRGRGMSFSEEKCNVIDLDDGDDDEGGGGNVAAGRMPVVVIDSDDEVESNENRMAGHFQGIVLPKPEGQFLTDLMFSDHAERRIHGEVVSLTGEPDITKDKGVYVGVEEDEVDTGIEDDGLGDIWKEMSFALESSKDVVENPQPDENMEEDEDYCDHSFVLKDDIGYVCRICGVIEKAIDTIIEIQFNKVKRNTRTYMSESRNAKDRDSNGMVGVDLFEEDLTLTDIPAHPRHMKQMKPHQVEGFNFLRNNLVADNPGGCILAHAPGSGKTFMIISFMQSFLAKYPHAKPLVVLPKGILSTWKKEFQIWQIEDIPLYDFYSVKADSRHQQLEVLKQWLEHKSILFLGYKQFSSIVCDDGKNQVSVTCQEILLRRPSILILDEGHTPRNENTDVLQSLAKVQTPRKVVLSGTLYQNHVKEVFNVLNLVRPKFLRMDTSRGIVKRILSKVNIPGARKQFKAGADAAFYDLVEHTMQKDQDFKRKVTVIRDLREMTSKVLHYYKGDFLDELPGLVDFTVVLNLSSKQKHEVQKLKKFAGKFKRSSVGSAVYLHPKLHSFSENSAVTDDMMDNLLETLDVRDGAKAKFFLNILSLCKSAGEKLLVFSQYLTPLKFLERLVMKVKGWILGKDIFVISGESSSDHREWSMDRFNNSIDAKVFFGSIKACGEGISLVGASRIIILDVHLNPSVTRQAIGRAFRPGQTKKVYAYRLVAADSPEEEDHTTCFRKEAIAKMWFEWNEYCGYQDFEVETVELDDSGDCFLESLLVRDDVRLLYKR

SEQ ID NO: 575 - protein, 903 aa, Vitis vinifera
MHSEPKQKRQKAGPNVVDYSDPFAIPNLLEGLDAGRFGSVTKEIEALCARRMQMLQPYYVMYPSLSYMCTDLGKKQGKKASKLVNREASHLAHEDVIDLEDDHVVDDALTATAVEDATLPVVIIDSDDEDCGDQKVSHPPQETAWPSFSYQEVVLRKPSVGLLANNPVVRDYVGSIAPKVEEGSLMGATEIRKDKDVYIGVGEKSLVANLEMKKVQGEYVGVEDDMETNEGNLRAKTEDDGLADMWQEFDLALQSSKDVAVDPGEDEKESKEECEHSFVLKDDIGSVCRICGVVNKSIETIIEYQYTKVKRSRTYMYEPRNTKDREPTDDPSDGLGFSEHNLTVTEIHAHPRHSMQMKPHQVEGFNFLVSNLVAENPGGCILAHAPGSGKTFMIISFMQSFLAKYPQARPLVVLPKGILATWKKEFLTWQVEDIPLYDFYSVKADSRPQQLEVLKQWVAEKSILFLGYKQFSSIVCGDGASKATIACQEILLKAPQILILDEGHTPRNENTDVLYSLAKVQTPRKVVLSGTLYQNHVKEVFNILNLVRPKFLKLESSRAVVKRIMSKVDIMGVRKQLKSNAADAFYDLVENTLQKDDNFRRKITVIQDLREMTSKVLHYYKGDFLDELPGLVDFTVLLNLSARQKKEVGNLNKFERKFKKNSVGSAVYLHPQLKYFAEKLAANESKTDEMTCQKKMDEILEQLDVRDGVKAKFFLNVLALCQSSGEKLLVFSQYLLPLRFLEKLTMKVKGWSPGKEIFAISGESSSEQREWSMERFNTSPDARVFFGSIKACGEGISLVGASRVLILDVHLNPSVTRQAIGRAFRPGQKKKVHVYKLVAADSPEEEDHNSCFKKELISKMWFEWNEYCGHHEFEAETVDVSDSGDLFLESPLLREDITVLYRR

SEQ ID NO: 576 - protein, 903 aa, Cucumis sativus
MDATIDFSHNSYATTNGLYYGKHKRLKLSSDGKDLSSTATFSAKKSNTLRQNKMNNSAKVIDYSDPFATNNLIDGLDCGHFGSVTKEIGALVSRKMQVLSPYIAKYPALSSMLFDLGRSRECKEAMNNQASQLVHNLIDLEDDSAIDVRSNNVEKSRLPILIIDSDEEDSKEQRVIHPFQEVVLPRPPGQSLFKDIAIVDHRTSRDRRASNGEEATPIGESGTINKDKGVYIGVEEDEDEVSGQANSEDDGLGDIWNDMQMALECSKDLDAAVDSSSNQPTTEDVDCEHSFLLKDDLGYVCRICGVIDRGIETIFEFQYNKGKKSTRTYISESRNKDSGNIVGVKISEDDLTVTEISAHPRHMKQMKPHQIEGFNFLISNLVSDNPGGCILAHAPGSGKTFMIISFMQSFLAKYPQARPLVVLPKGILATWKKEFQIWQVEDIPLYDFYSVKADNRAQQLTVLNQWVEHKSILFLGYKQFSTIVCDVETSAASTACQNILLQVPTILILDEGHTPRNENTDTLQTLAKVRTPRKVVLSGTLYQNHVKEVFNIVNLVRPKFMRSETSRPIIKRIMSRVDIPGARKQFKAGVDAAFYDLVEHTLQKDTDFRRKVSVIHDLREMTSKILHYYKGDFLDELPGLVDFTVVLNLTSKQKHEGEKVKKFNRKFKISSAGSAVYLHPKLNVFSVNAAVTDDKIDEVIDKMDVKDGVKTKFFLNLLNLCATTGEKLLVFSQYLLPLKFMERLVVQKKGWSPGRETFMISGETTPEQREWSMERFNNSPDARVFFGSIKACGEGISLVGASRIIILDVHLNPSVTRQAIGRAFRPGQTKKVFAYRLVAGDSPEEGDHSTCFKKELIAKMWFEWNEYCGYHDFEVETVDVKQCGDNFLETPLLGQDVKVLYRR

SEQ ID NO: 577 - protein, 815 aa, Arabidopsis lyrata
MFVFAKKLKSLPASKHERSEANQKSSSLRCHIQFLFIFLKFSSKVPTFNSLMEILHPDQATSNGFYKNVHKRKQNQVDDGLCSDSEAKRLKSSSKVIDYSNPFAISNMLEALDGGKFGSVTKELQEIADMRMDLIKRCIWLYPSLAYTEFEDEKTMLSLDNQQVVEGGVINLDDDDDDDDDVSNKAICVVPSSEIVVLDSDDEDNERQRSTYQFQSTLVQLQKNQGDVTPVTPQFTFEEVDLGRSKEMMPSVIKAIVEGQTSRDKVIAIENGVANEKGVYVGVEDDDIDNESEAADEDLGNIWNEMAMSIECSKDIAWETSHKQKADVVEDCEHSFILKDDMGYVCRVCGVIEKSILEIIDVQFTKAKRNTRTYASETRNKRFGESDAELKFSEEGLMIGGLAAHPTHADKMKPHQIEGFQFLCSNLVADDPGGCIMAHAPGSGKTFMIISFMQSFLAKYPQAKPLVVLPKGILSTWKKEFLRWQVEDIPLLDFYSARAENRAQQLAILRKWMEKKSILFLGYKQFSTIVCDDTSTDSLSCQEILLKVPSILILDEGHTPRNEDTNVLQSLAQVQTPRKVVLSGTLYQNHVKEVFNILNLVRPKFLKLDTSKSIVKRILSYAPISDVRSHMGNNSDVSSAFNEIVEYTLQKSEDFTMKINVIQDLREMTKKVLHYYKGDFLDELPGLADFTVVLNLSPRQLNEVKKLRREKRKFKVSAVGSAIYLHREAETIGRAFRPGQTKKVHAYRLIAGSSPEEEDHNTCFKKEVISKMWFEWNEYCGYRNFEVETIDVDDADDMFLESPTLREDIRVLYKR

SEQ ID NO: 578 - protein, 163 aa, Arabidopsis thaliana
MQSSMTMELRPSGDSGSSDVDAEISDGFSPLDTSHRDVADEGSLLRRAEMYQDYMKQVPIPTNRGSLIPFTSWVGLSISMKQLYGQPLHYLTNVLLQRWDQSRFGTDSEEQRLDSIIHPTKAEATIWLVEEIHRLTPSHLHMALLWRSDPMYHSFIDPIFPEK

SEQ ID NO: 579 - protein, 175 aa, Ricinus communis
MKRTMPWNEQIDVISSDESTSSDGDMETDVVLDGHKPSPRITISQSLKEITSEDVLIRRAEMYQDYMRQLPIPVHHGSVIPFSSWVGLGKSIKQLYGQPLHYLTNILLKQWDQLRFDNGDEQKSLDIVIHPCKAEASVWLVEEIHRCTSSPHYVAKLWLLDPMHHAFVDSIFPPL

SEQ ID NO: 580 - protein, 165 aa, Glycine max
MKRSFPWENQIDVSSSSSPNSLRPNPLTIPNSPIDTKSQDALIRRAEMYQDYMKQIPIPNHRGTMIPFTSWMGLGRSMKQIYGQPLHYLTNILLKQWDQLRIGSEDEYKPLDNIVHPHKAEATIWLIEEIHRQTSSHFHLASLWKVDPMYNGFVDSIFPTLEHTS

SEQ ID NO: 581 - protein, 218 aa, Zea mays
MKRAAPSQEPLDVSSGDSSGSDSDQLGGKDKGGSASKAAAGAEDVKRVVLHKESQDVSSDDDLSSDSDDDAGKGNAWNAFGLPNSSKAASTAEGALIRRAEMYQQYMKRIPVPAYRDSVIPFTSWLGLAGSLKQLYEQPLHYLTNVLLKKWDQQRIGSDDEHRRLDAIIHPARAETLVWATEEVHRLTTSGQHLASLWASDPMYHAHVDPVFASVKLE

SEQ ID NO: 582 - protein, 179 aa, Medicago truncatula
MKRPFPWDEDEIDVSDSSSSDDSPNETPNVATVLPSIHIHIPLPNPSSDVNSLDALTRRAAMYQDYMKHIPIPSSRGSLIPFTSWMGLGRSIKQLYGQPLHYLTNILLKQWDQLRIGSEDEYTPLDDIIHPRKAESTIWLMEEIHRQTSSHFHIADLWKKDPMYHGFIDSIFPKLEDTS

SEQ ID NO: 583 - protein, 173 aa, Oryza sativa
MKRAAPWEEPLEVSSDDSLSSDSDDEAGKGKGDNAFGLPNSTKAAAPDGALIRKAEMYQEYMKHIPVPAHRGSVIPCTTWLGLGRSVKQLYKQPLHYLTNVLLKQWDQQRVGSDDEHRPLDAIIHPVKAEALIWITEEVHRLTTSSQHLASLWASAPMYHAYIDPVFPPIKLQ

SEQ ID NO: 584 - protein, 175 aa, Populus trichocarpa
MKRTIPWTDPVDVISSDESSSSDSDIELNDGLDGQRLSNYVTIDQPIKETTSEGVLIRRAEMYQDYMRHIPIPVQRGSAIPFSSWAGLGKSIKQLYQQPLHYLTNILLNKWDQQRIGSEDEHTPLDIMIHPCKAEATIWLVEEVHRRTSSHHHVAKIWQSDPMHHAFVDSIFPKL

SEQ ID NO: 585 - protein, 137 aa, Vitis vinifera
MDITIDQPARQEPFEDVVIRRAEMYQEYMKQIPIPARRGSLIPFDTWMGLAKSIKQLYGQPLHYLTNILVKQWDQLRIGSKDENRSLDSIIHPSKAEASIWLIEEVHRQTTSPHHMAKLWLSDPMHYAFVDSIFPQI

SEQ ID NO: 586 - protein, 174 aa, Cucumis sativus
MKRPMPWNEQVDIISSGESSSSDSEAAIQNDGYEFKPSLDDFKIPAKEMTSEGMLMKRAEMYQEYMKQIQIPAQRGSVIPFTTWMGLGKSIKQLYGQPLHYLTNILLKQWDQLRLGSADEYKPLDTVIHPSKAEATVWLVEEIHRRTSSHHHVAKLWLSDPMHQAYVDSIFPQL

SEQ ID NO: 587 - protein, 167 aa, Arabidopsis lyrata
MQSSMTLELRPSADSGSSDVDAEISDGFSPLDNSHRDVADEGSLLRRAEMYQEYMKQVPIPTNRGSLIPFTSWVGLSISMKQLYGQPLHYLTNVLLQRWDQSRFGTDSEEQSLDSIFHPSKAEATIWLVEEIHRITSSHLHIASLWGSDPMYHSFIDPIFPKIETSS

SEQ ID NO: 588 - protein, 710 aa, Arabidopsis thaliana
MADMRRRNGSGGSSNHERNEQILFPKPETLDFDLPCDTSFPQQIGDNAASSSGSNVKSLLIEMGFCPTLVQKAIDENGQDDFELLLEILTKSTETEPPGPSFHGLMEPKPEPDIEYETDRIRIALLTMKFPENLVDFALDRLGKDTPIDEMVDFIVAAQLAEKYAEESEDSLDGAEINEEDEDVTPVTARGPEVPNEQLFETMDKTLRLLEMGFSNDEISMAIEKIGTKGQISVLAESIVTGEFPAECHDDLEDIEKKVSAAAPAVNRTCLSKSWRFVGVGAQKEDGGGGSSSGTANIKPDPGIESFPFPATDNVGETSRGKRPKDEDENAYPEEYTGYDDRGKRLRPEDMGDSSSFMETPWMQDEWKDNTYEFPSVMQPRLSQSLGPKVARRPYFFYGQLGELSPSWWSKISGFLFGIHPEHVDTRLCSALRRTEGYLHNLPTVNRFNTLPNPRLTIQDAMPHMRSWWPQWDIRKHFNSGTCSNMKDATLLCERIGRRIAECKGKPTQQDQTLILRHCHTSNLIWIAPNILSPLEPEHLECIMGYPMNHTNIGGGRLAERLKLFDYCFQTDTLGYHLSVLKSMFPQGLTVLSLFSGIGGAEIALDRLGIHLKGVVSVESCGLSRNILKRWWQTSGQTGELVQIEEIKSLTAKRLETLMQRFGGFDFVICQNPSTPLDLSKEISNSEACEFDYTLFNEFARVTKRVRDMM

SEQ ID NO: 589 - protein, 678 aa, Ricinus communis
MQLISFSNSNAVLSWLTAEASGHDKMRKVHNGETSSNQKTTVPKPEMLDFDFPSDFIYSSQLGETAASSSASDVRSFLTGMGFLPSLVDKVIQENGEDNVDLLLEILMECSDPQKSNSQSSDSLDTLFNDKDASNPPEYSKFGQPKEEPDVFGFDDSKRASLLHMNFSAEEVDFAMEKLGTDAPVDEIVDFITAAQVAANFDEERDDELEHDVEQNKYCSRHSRMNPSHVARGGESFNMEIRDEQRRDSYGRKKPENLSQEAVSRSSNLNLEEIHRGKRPKQEYTEGYSNTQDEHFGFEENYEEEGPKPEYTADSSFSFESAWVEEKVDTEITGFRIPREPKFKSCKSVDRMVAKPPYFLYGNVATVSLDTWGKISQFLYAVEPEFVNTQFFSALSRKEGYVHNLPTENRFHILPKPPMSILDAMPHIKKWWPSWDTRKQLSFINYETNGLSQLCDRLGRMLTDSRGLISSQQKRDILHHCHKLNLVWVGLHKVRPIEPEHLELILGYPLNHTQTTEGSLTERLHALRYSFQIDTLGYHLSVLKSMFPEGITVLSLFSGIGGAEVALHRLGIHMKGVVSVETSETKRKILRMWWRNSGQTGELEQIEDIQKLTTKKIDRLIERFGGFDFVICQSPCTCASGNPKMEQRADARSALDFSLFCEFVRVLQRVRTQVQRKR

SEQ ID NO: 590 - protein, 694 aa, Glycine max
MAGNPNRREGKTVMVPKTENLDYELPPYTSFSGDVGDNVASSSGGKLRAFFIGMGFLPCLVDKVIEENGEENSDILLEALLRYSALQKSNSQSSVSLDSLFDDKDPPEISNVNQAKEEPDELSGVVDDTRGSLLMMNFSVEEVEFAIHKLGDEASIPELVDFIFALQIAKKLKKEPDDITFTYYGRGNEVTNEKLFGIMAKTLQLFEMGFSENEVSSAIDKLGSEAPISELANFIFAEQNGIDYVMEYKFPTTSTYSVGIKEEPEMDLYGTAEVKVEGFSHEPPQSSQVNLEETYNDDMVKEEEGIDAFPSNVSDQYLDVVENGRGKRPKYEHDDDPVNCLEPSWVEERVDAVVAEMSRHPKPNPSRCLSSVAAKPPFFLFGNVSNISYDSWTKMSQFLYGIEPEFANAQSFSAMDRIEGYIHNLPVENRFHILPKPPMTIEDAMPQTKKWWPPWDSRKLLSSIYCETNGIAQTCDRLGNFLADSGGVLTSEQQKDILRYCRRLNLVWIGKFKLGPVEPEQLELILGYPLNHTRATEGNVAERLKSLKYCFQTDTLGYHLSVLRPIFPHGLTMLSLFSGLGGAEIALHRLAIKIKAVVSVETSETKRKILEKWWRQSGQTGTLVQIEDIQKLTSKKLEGLISKFGGFDLVIYQNPCSYSSSRLQAGVGLSALDFSVFCECVRVLQRVRGMYQRK

SEQ ID NO: 591 - protein, 659 aa, Zea mays
MVKVEDQAEDGGADADARGLRESALDPLPVSVHASLKEEEGQPSSSSGKLRSQFIGMGFSSKLVDKVLQRHGDDDSNTILESLLSYSDLQQSGSESSDSFGSFFDNDNEENNSPSESRKGIYQDIKPELDSFSEKWSFLLRTMNFSQQEVDLAFKQLGDEAPLEQLVDFIVSAQSGVPSGGLQTGDATNEGKTELLYGVMEKTLSLLQMGFTEEEVSSAIDNFDQRATVQELADSILARRIANSIEQKEIKVESDFLDEAETDYSSYQPSYSDVSYYDDDNNNTRVKRAKHIFIDDIGASSSHLGDPWSMGQRAGTNDMSVKVELEAMTPGRRANVQGDLAKPPFFLYGNVVEVPKDTWHQLKQFLYNVEPEFVNSQSFSALTRREGYIHNLPVEKRSVVVPKSPMTIEEALPFTRQWWPSWDTRKHISVITTEAAGIEQTCERLGGMVRESRGVLSQARQMQIIHQCRVSNLIWVGRDRLGPLEPRQVEKILGYPYNHTNLFELNQPDRLAAMKYAFQTDTLSYLLSVLKGKYQDGIRVLSIYSGIGGAEVALHRLGIPLKCVISVEESEVNRKILRRWWLKTEQTGVLRQHAGIWKLKTHVIEDLVKEFGGFDLIIGGNYTSCKGGTTVNTTMGMDSNRFYEYNRVVKRVRTAVGLS

SEQ ID NO: 592 - protein, 1032 aa, Medicago truncatula
MTGTSNGRGGKNPVFPKTEDFDYELSPYTALSRDFRETAASSSGSKVRGFFIGMGFLPGLVDKVIEENGTLCVSEENSDALLEILLRCSTNGDSSDSLEGSLNTNEHRSIPNFFPNAHSKEALQISNLESSDSLDSLFDDKDSPEVSMINQPKEEVDEIFEDIEDSRGTLLMMNFSAEEVEFAIRKLGNKAPVPELVDFIFAAQIAKKMKKEEAEEDDIKCYVREKEISNEQLFGIMAKTLQLFEMGFSENEISSAVDKLGPDVPISELANFIFAEQNGIEYVMEYKYPSGPSYSWIKEEEQSDMYGTAEVKVEDFSHEPSQSRQVNLGETGTGERVKEEDYIDEFPDDVKPGFMENDRNKRPKYEYDDNSNSSLDPYWVEEMVDTVVATMSRRNKSTPSRSLSSVAAKPPFFLFGNVSNITYDSWKKMSQFLYCIEPEFVNTELFSALNRIEGYIHNLPTENRFQILPKPPMTIEDAIPRTKKWWPPWDSRKKLNCNYCETGGITQLCDRLGRALANSGGILTSQQQKDILRYCRGLNLVWTGKYKLGPIEPEHLDHILGYPLNHTRTDECDLTERLQLLKHSFQTDTLGYHLSVLKPIFPTGVTLLSIFSGIGGAEVALHRLGIKIKALVSVETSATKRKILEKWWRSSGQSGTLVQIEEIQKLTSKKFENLINNFGVFDLVIYQNPCSQPIVRPHQVGGLSAVEFSAFCESVRILQRVRALCERREMTVSLPVLSEVIWKVLVGLVKQGDDSFTSSVVRSDMEGSMVDRCPRYDIKKVGVLRWGYCRREEGKNANESGEATAKSAKGVIVIEGLITSLALALGLESELANLVALEDCTQLDLHSCMNQKFVQVKGKIQFYLMIKNELVRSIVLPNREQINVRNENNWLFDLEAPESPLAAHPAAAYRADDAHEGGGTDDEYDRQERLSPAHSYPHLTPSPDRHIPPHTQAPDYTPHLPHICTLVSTSYTSQSSVEYELNALRPEVANLRATQQERSDRETERDHQMRVNNHMIRQMFTWITRHDMPPAE

SEQ ID NO: 593 - protein, 576 aa, Sorghum bicolor
MADRVGGSDDGDKSEWNSDGEVARSLDGAGSPIAPSRNKLKDAPGPSLLVNGAGPSASLVEDFVGMGLIKGNGDGGAESLLELLLAYKAIGNDPSLDKSSASVCGPRTICDDKDILANWDAHDASTSSDRDHASDDSGDEDFLQGLSQKDEKIESLVRMGFPKDEAEMAIVRCGQDAPMSVLIDLIYSSEASEDGYYGNFSGHEDDSFGGRKEKRKRSEDAEQGSSHDEPMPLPNPMVGFNLPNVSLRSVDRSLPSKAIGPPFFYYENVAIAPKGVWTTISQFLYDIQPEFVDSRFLCAAARKRGYVHNLPIENRSPLLPLPPKTIFEAFPHTKKWWPSWDPRKQFNCLLTSMAKPKLTEQIHHALAKCKDPPPRRVQKYVLETCRTANLVWVGLNKVAHLEPDEMEFLLGFPKDHTRGIGRPERFKSLGNSFHVDTVAYHLSALRDMFPHGMNVLSLFSGIGGAEVALHRLDIRMKTVVSVEISETNRFVLRTWWNQTQTGTLIEITDVQSLTTERLESCIRRIGGFDLVIGGSPCNNLAGRNRFHRDGLEGEQSSLFYHYYRILDTVKSIMGRM

SEQ ID NO: 594 - protein, 680 aa, Oryza sativa
MVKVEDDVEGSGINASVGDLRDAAVNPQPALLRATVKEEEGQPSSSSSHVRSQFIGMGFSPMLVDRVLQKHGDRDSDTILEALLSQSALQKSGSESGSLGDLFDSDNEENSSHFAPRKEVIQDIKVEADSSSEKRSYLLSTMNFSQREVDLALNQLGEEASLEQLVDFIVTGQVSGCSGGNENGDASNEVKDESLFGVMDKTLHLLQMGFTEEEVSSVIDKAGPEATVLELADTIFARRIASSIEQKEVKVEPDFLDETETSYSAYHPSNSGLRYYDDDHDNIRIKRAKHMFIDDSAGSSSRAGNQPNLDPWLKDHRATTSDGSVKEEFDAMTPGIRRNVRSDVANPPYFLYGNVVEIPKATWRQLSEFLYNVEPEFVNSQFFSALSRKEGYIHNLPTEGRRNLVPRSPMTIEEAFPFTRQCWPSWDTRKQLNSVATEVAGIEQLCERLGKMVRDSGGYLSQEKKTHIMHQCKLANLIWVGPDRLSPLDPQQVERILGYPRKHTNLFGLNPQDRIEAMRYSFQTDTLGYLLSVLKDLYPDGLRVLSIYSGIGGAAIALHRLGIPLQCVVSVDQSDTNRKILRRWWSNTEQKGQLRQINTIWKLKINVLEDLVKEFGGFDIIIGGNFSSCKGGTTVNSSMGMDSNQFFEYVRVVQRVKHIMGRLQVRAHESARHRHRSPSN

SEQ ID NO: 595 - protein, 660 aa, Brachypodium distachyon
MVKTEDQDEDEGVSASVGALRDGTVDPQPDTAHAGVKAEEDGQPSSSSSYSKFIGMGFPPTLVDKMLQKHGDKDFNAILESLLFHSSLTKSGSESSSSLGSLFDSDSEENISRLGSMKEPHEEIKPEPDSFSERRSYLLSAMNFSQQEVDWAFNQLGEEAPLDQLVDTIVTAQVAGFTGGNENVDATTEGKAESLFGVMEKTLHLLQMGFTEEEVSGAIDSSGQEATVQELADSIFARRIDNSIKQTEVKIESDFLGGTENQHSTCHQRLRYYDDEDDKIGVKRAKSIFTDNSSGASSSRPGNQPSLTPWLSGCTGSVSNGYVKEEFDAMASGPRPDVRPEIAKPPYFLYGNVVDIPKGTWHQLSDFLFNVEPEFLNSQYFSAVMRREGYLHNLPMETRHIVVPKSPMTIEDALPFTRQWWPSWDTRKHIGVVTLDVAEIEQMCEKLGKIMTDSRGVLSHEKQAHIMQQCKMSNLIWIGKDRLSPLEPHQLEHILGYPRNHTEQFELNTPDRLAAMKYTFQTDVLAYLLSVLKSKYPNGLRLLSIYSGLGGAEVALDRLGIPIKCIVSVEESDVNRKILRKWWRRTNQAGELRQFVGIWKLKTIVLEDLVKEFGGFDLIIGGNYSSCRGGRTINATMGMDSNKFYEYARVVKIVRALHNS

SEQ ID NO: 596 - protein, 661 aa, Populus trichocarpa
MGYSPSLVNRVIEENGEDNVDLLLEILMECSGLQKPNSQSSDSLDCLFDDRGESSPPKYSTVTGVKEEPDVFDEVYDDKRVSLLKMNFPAKEVELAMDKLGENAPINEIIDFIIAAQIANNLDRETEDMPDIDAENKEDVNDETLYGTMDKTLCLLNMGFSENEVSLAIDKFGSEVPVTELANAICAHQLGETYVIKKKYSENSTASCSSAAEDSRSFGVETENNTRHHSFSWVKSETEDCRRDAILQSRDMNTKETRKGKRPRQEHIEGYQEAQPRHDSLEENCAGEQPKQEYDYGSSSYFEHEWVEEKVNSDTTTFGMPKPFKCNPCKILDQIAAKPPYFFYGNVATASSDTWGKISQFLYGIEPEFVDTQFFSALSRREGYIHNLPTENRSHILPKPPITLEDLMPSTKKWWPSWDARKKMSCRNFDSSGSSQLCDMLGRMLDDSRGLLSAEQQRDLLRHCQALNLMWVGPNKLSPLESAHLEKILGYPLNHTLIADYPLTERMYSLRYSFQTDTLGYHLSVLKSIFPQGITVLSLFSGIGGAEITLHRLGIHLKGVVSVETSETNRRVLKRWWYSSGQTGRLEQIEDIRKLTSSTVERLVENFVCFDFVICQNSFTRPSKIPGVGSGLESQHFFDFTLFNEFVRVLQRVRSAIERKR

SEQ ID NO: 597 - protein, 712 aa, Vitis vinifera
MGEIADYSDSKSSSETVGERGTMIKVEPLELNLPTENMCARHIGHNGASSSGSKLRSSFIGMGFLPSLVDKVIEEKGEDDVDLLLETLCANAALQKSISESSDSLDSFLNDEDTNNPPKFSAGFHPKEEPDVSSGVNDDKRATLVMMKFSVDEVEFAMDKLGEGAPVNELVDFIIAAQIAGSSKMDADDPTYGNEERKEDCNNEALFGTMDKTLRLLEMGFSENEISSAIEKFGSEVPISELADSIFAGQIAEKDKHSSATFRLNHSHTGNDYRSFGKGMEDGLKRRSSGTFMVKTEEYSPEAVSQLRAVDIGDDHKGKRPKQESLDDSSAYIGPTWLEGRKGDHKFSSCRMPLPRRDLNQVAGQLNKFGMSSISKPMPCKSLDQLVAKPPYFFYGNVTNVSHDSWNKISQFLYALEPEFVNTQFFSALNRKEGYIHNLPSENRFHILPKPPMTIEEVIPYTKKWWPSWDTRKQLSCISSETSGISQLCDRLGKILVDSRGLLSFEQQRDILHHCRTLNLVWVGQCKLSPIEPEHLERILGYPLNHTRVPEYSLIERLQSLRHCFQIDTLGYHLSVLKSMFPKGLTMLSLFSGIGGAELTLHQLGIHLKGVVSVEISETKRNILKKWWHNTGQTGELVQIDDIQKLASSKLESLIEKFGGFDFVICQNPCTYSSRNSKMVADGDSLTGFDFSLFCEFVRVLHRVRSTMERRR

SEQ ID NO: 598 - protein, 724 aa, Cucumis sativus
MASNKPIVPKEEVFDFRLPPDRMYSRHVGDSGASSSGSNVRTFFIDMGFLPSLVDSVIEKNEQKSIPQSSDSLEGLQSGKMGSNPPHVSTVCHKQVQAAQTSKSESSDSLDSLFDDKDAHNEISSVIPKEEADDYYHISDTNKASLLVMNFSADEVDFAIDKLGGDAPLNELVDFIIAAQIAIKLEKETDDAFCRNELKKEENDETLFVTMEKTLRLLEMGFSENEVSLAIEKFGSETQVSELADSIVTGRIASDYPGDVKCSPSSFGIGGLYTREDYVTKVKAEESSSAVGPLPRNVNIEAIQKGKRPKEENMDDLLNPTTRLNKHKGKRPKQEYADDLGSLYGPGWVESKVNPDITSFDIPPSSRLNLSRSLDKLVAKPPCPPLKSNPSRALEKVVTKPPFFLYGNVLDISRDSWAKVSKFLYAVEPEFVDTRSFSALSRTEGYVHNLPCENRFHIIPLPPMTIQDATRTKKWWPSWDTRKYLSCINSETRGVPQLCDRLTKTLTDSGGHPSSHEERDILHHCIALNLIWVSQFKLAPVEPEQLECVLGYPVNHTQDAESSSIERLQYLKYCFQTDALGYHLSVLKSMFPEGLVVLSIFSGIGGAEIALHRLGIHLKVVVSVESSAAKRRILKKWWHSSGQTGELEQIEDIQKLTSIKINNWITKYGGFDLVICQNPCSRCLSSSKLNQSGDAEGIASFDFSIFYEFVRVLQSVRNTMHRKK

SEQ ID NO: 599 - protein, 743 aa, Arabidopsis lyrata
MVWNLATLGLLLSFCLESLFQFVFFLSGILQGDLRRRNGNGGSSNHERNEQILFPKPETLDYELPCDTSYPHQIGDNAASSSGSNVKSLLIEMGFCPTLVQKAIDENGEDDIEFLLEILTKSTVTEQPGTSFHGLMEPKPEPDIEYETDGRRIALLTMQFPENLVDFALDRLGKDAPIDEMVDFIVAAQLAEKYAEESEDSLDGAEINEEDEDVTPVTARGPEVPNEQLFETMDKTLHLLEMGFSNDEISMAIEKIGTEGQISVLAESIVTGEFPAVCHDDLEDIEKKVSAAAPAANRACLSKSWRFVGVGAQKEDGCGGSSSGTANIKPDPGIDSFPFPATANVGETSKGKRPKDEDENAYPEEYTDHDDRGKRLRPEYMGDSSSFMETPWMQDEWKDNTYEFPSVMQPRLSQSLGPNVAKRPYFFYGQLGELSPSWWSKISGFLFGIHPEHVDTRLCSALHRTEGYLHNLPTVNRFNILPKPRLTIQDAMPQMKSWWPQWDIRKHFNSGTCSNRKDVTLLCERIGRRIAECRGKPTQQDQTLILRHCHTSNLIWIAPNILSPVEPEHLECIMGYPTNHTNIGGGRLAERLKLFDYCFQTDTLGYHFSVLKSMFPEGLTVLSLFSGIGGAEIALDRLGIHLKGVVSVESCGLSRNILKRWWQTSGQTGELVQIEEIKSLTTKKLETLVQRFGGFDFVICQNPSTPLDLSKEISNSEACEFDYTLFNEFARVTKRVRDMMELS

SEQ ID NO: 600 - protein, 626 aa, Arabidopsis thaliana
MVIWNNDDDDFLEIDNFQSSPRSSPIHAMQCRVENLAGVAVTTSSLSSPTETTDLVQMGFSDEVFATLFDMGFPVEMISRAIKETGPNVETSVIIDTISKYSSDCEAGSSKSKAIDHFLAMGFDEEKVVKAIQEHGEDNMEAIANALLSCPEAKKLPAAVEEEDGIDWSSSDDDTNYTDMLNSDDEKDPNSNENGSKIRSLVKMGFSELEASLAVERCGENVDIAELTDFLCAAQMAREFSEFYTEHEEQKPRHNIKKRRFESKGEPRSSVDDEPIRLPNPMIGFGVPNEPGLITHRSLPELARGPPFFYYENVALTPKGVWETISRHLFEIPPEFVDSKYFCVAARKRGYIHNLPINNRFQIQPPPKYTIHDAFPLSKRWWPEWDKRTKLNCILTCTGSAQLTNRIRVALEPYNEEPEPPKHVQRYVIDQCKKWNLVWVGKNKAAPLEPDEMESILGFPKNHTRGGGMSRTERFKSLGNSFQVDTVAYHLSVLKPIFPHGINVLSLFTGIGGGEVALHRLQIKMKLVVSVEISKVNRNILKDFWEQTNQTGELIEFSDIQHLTNDTIEGLMEKYGGFDLVIGGSPCNNLAGGNRVSRVGLEGDQSSLFFEYCRILEVVRARMRGS

SEQ ID NO: 601 - protein, 686 aa, Ricinus communis
MGVIVYCFRITTCKPVYMEHKTLYLEILGIAVASKEMDGDSFCGEGDNFDWDSEDEREIENFGLTNSSCLAVPAVEATARSVEKCLMGFSCILRHASSSVRSSGTKVMDHFVGMGFPEKMVAEAIQENGEENADLILETLLKFSTISSPSSSGSKLIDHFVGMGFDVEMVDRAIQENGEEKTDSILETLLTYSVIEKSHQEQPHVDSDHWSSEYEGSFLNDFSDIDSSENEENGKSQPVEGNTLRFLARMGYTTDEASIALERCGPDANIAELTDFICAAQMAKAADASFPEEKPKIRHFDDDYPKNKKRNYAEYDMWKKKKQMKLDKKLLNGDDELIRLPNPMLGFGVPTDPAIVTHRKLPEAALGPPFFYYENVALAPKGVWQTISRFLYDVEPEFVDSKYFCAAARKRGYVHNLPIQNRYPLLPLPPNNIHEALPLTKRWWPSWDTRTKLNCLQTCVASAKLTDRIRKALEDYEGEPPLSIRKYVLDECRKWNLLWVGRNKLAPLEPDEVEMLLGFPRNHTRGGGISRTDRYKSLGNSFQVDTVAYHLSVLKDMFPEGISLLSLFSGIGGAEVALHRLGIRLKRVVSVEISEVNRNIMRCWWEQTNQTGTLIDIADVHDLNADRLEQLMSSFGGFDLVVGGSPCNNLAGSNRHHRDGLEGKESSLFFDYCRILDLVKCIMTRN

SEQ ID NO: 602 - protein, 590 aa, Glycine max
MGGDDSGLESDNFDWNTEDELEIQNYNSSSSCLTLPNGDAVTGSGEASSSAVLANSKVLDHFVSMGFSREMVSKVIQEYGEENEDKLLEELLTYKALESSSRPQQRIEPDPCSSENAGSSWDDFSDTDIFSDDEEIAKTMSENDDTLRSLVKMGYKQVEALIAIERLGPNASLEELVDFIGVAQMAKAEDALLPPQEKLQYNDYAKSNKRRLYDYEVLGRKKPRGCEKKILNEDDEDAEALHLPNPMIGFGVPTESSFITHRRLPEDAIGPPYFYYENVALAPKGVWQTISRFLYDVEPEFVDSKFFCAAARKRGYIHNLPIQNRFPLLPLPPRTIHEAFPLTKKWWPSWDIRTKLNCLQTCIGSAKLTERIRKAVEIYDEDPPESVQKYVLHQCRKWNLVWVGRNKVAPLEPDEVETLLGFPRNHTRGGGISRTDRYKSLGNSFQVDTVAYHLSVLKEMYPNGINLLSLFSGIGGAEVALHRLGIPLKNVVSVEKSEVNRNIVRSWWEQTNQKGNLYDMDDVRELDGDRLEQLMSTFGGFDLIVGGSPCNNLAGSNRVSRDGLEGKESSLFFDYFRILDLVKNMSAKYR

SEQ ID NO: 603 - protein, 603 aa, Zea mays
MVHWVSDSDGSDNFEWDSDGNGEQTVSFNAAGAGSSALAATNTDAPGPSTRVANGNGKAGRSASLVQKYVDMGFSEEIVLKAMKDNGDNGADSLVELLLTYQELGNDLKVDNDFASSCAPKTADDSDDDDTLEIWDDEDAGGRSTRVANSVDDSDDEDFLHEMSRKDEKVDSLVKMGFPEDEAALAITRCGPDASISVLVDSIYASQTAGDGYCGNLSDYEDNSYGGRSTGNKKKRKRYGGQAQGSRGPLDGSCDEPMPLPHPMVGFNLPDQWSRRVDRSLPAQAIGPPYFYYENVALAPKGVWTTISRFLYDIQPEFVDSKYFCAAARKRGYIHNLPLENRSPLLPIPPKTISEAFPRTKRWWPSWDPRRQFNCLQTCVSSAKLLERIRVALTNSSDPPPPRVQKYVLEECRKWNLAWVGLNKVAPLEPDEMEFLLGFPKDHTRGISRTERYRSLGNSFQVDTVAYHLSVLKDLFPQGMNVLSLFSGIGGAEVALHRLGIRMNTVISVEKSEVNRTILKSWWDQTQTGTLIEITDVQTLSSERIEAYIRRIGGFDLVIGGSPCNNLTGSNRHHRDGLEGEHSALFHHYFRILHAVKSIMERL

SEQ ID NO: 604 - protein, 588 aa, Medicago truncatula
MGDYSGLDSDIDWNTDDELEIESFQPSCSTVVPSGQTITAGSVEPSSFAGPSNTKVFDHFISMGFPGEVVSKVIQEHGEENEEKLLNEILTYSVLESSPQQQQPAELDPTSSECAGSSWEDLSEDDFFSDEELPKFDSTNDDTLTKLVKMGFEEEEALVAIDRIGSDSLEALVDFIGAAQVAKAENALLLPEDKPGCSGNPKLKKRSLYEYEVLGKKRPKLEKRTLCEDEEEAQTLNLPNPMMGFGIPNEPSSMITHRRLPENAVGPPYFYYENVALAPKGVWQTISRFLYDVEPEYVDSKYFCAAARKRGYIHNLPIVNRFPLLPLPPRTIHDAFPLLRRWWPTWDPRTKLNCLQTVHASAKLTDRIRKAVESCDDFEEPSETVKKYVLDQCRKWNLVWVGKNKVAPLEPDEVEMLLGFPRNHTRGGGISRTDRFKSLGNSFQVDTVAYHLSVLKEMYPKGVNLLSLFSGIGGAEVALHRLGIPLRNVVSVEKSEVNRNIVRSWWEQTNQRGNLVDFDDVQQLDADRLERLMGAFGGFDLIVGGSPCNNLAGSNRVSRNGLEGSESILFYEYFRILDLVKVMAPRFR

SEQ ID NO: 605 - protein, 740 aa, Sorghum bicolor
MPVAYHQRPAHCWCCLAGAAREFLVETCLEIRRLPLSSKSGQSRDGGGRQSRPVAGAASCSSSSSATASQLPARRGRRRREGRSGRGSPRRGGADGDGRGEAAEVVRGGAERGCAVPLRPVPQPPEPLREGSGMAHWVSDGDGSDSFEWDSDGNGEEAGSFNTAGASSSAMASTNTDAPGPSRRVSQVANGNGKAGPSASLVQRYIDMGFAEEIVVKAIKDNGDNGADALVELLLTYQELGNDLNVDNGFASGCVPQTVDDSGDDDFLENWDDLDAGGRSTRVANSVDDSGDEDFLHEMSQKDNKIDSLVKMGFPEDEAALAITRCGQDASISVLADSIYASQTAGDGYCGNLSDYEDGGRNKGRFMDGNNKKRKRYGSQALGSRGPLDGSADEPMLLPNPMVGFSLPDQWPRPVNRDLPALAMGPPYFYYENVALAPKGVWTIISRFLYDIQPEFVDSKYFCAAARKRGYIHNLPLENRSPLLPKPPRTITVAFPHTKRWWPSWDPRQQFNCLQTCVSSAKLLEKIRVTLTNSSDPPPPRVQKLVLEECRKWNLAWVGLNKVAPLEPDEMEFLLGFPKDHTRGICRTERFRSLGNSFQVDTVAYHLSVLKDMYPEGMNVLSLFSGIGGAEVALHRLGIRMKTVISVEKSEVNRTILRSWWDQTQTGTLIEINDVQTLTSERIEAYIRRFGGFDLVIGGSPCNNLAGSNRHHRNGLEGEHSSLFFQYVRILESVKSIQRL

SEQ ID NO: 606 - protein, 598 aa, Oryza sativa
MVDWASDSDNDKFEWDTDGEAETSSAPALRNIDAPGPSTRLPQDANGKANGSGALVAEFMGMGFPKEMILKAIKEIGDTDTEQLLELLLTYQAIGGDASVGNCSASACAPQTLEVDEEEDDTNWDEYDTAGNCDRTPHSDGSGDEDFFQEMSEKDEKMKSLVNMGFPEDEAKMAIDRCGLDAPVAVLVDSIYASQEAGNGYSANLSDYEDTEFSSFGGRKKTRFVDGSKKRKRYGSGPSGNQVPFDGSHEEPMPLPNPMVGFSLPNERLRSVHRNLPDQALGPPFFYYENVALAPKGVWTTISRFLYDIQPEFVDSKYFCAAARKRGYIHNLPIENRSPVLPMPPKTISEAFPNTKRWWPSWDPRRQFNCLQTCMASAKLTERIRCALGRFSDVPTPQVQKYVLDECRKWNLVWVGKNKVAPLEPDEMEFLLGYPRNHTRGVSRTERYRALGNSFQVDTVAYHLSVLRDLFPNGMNVLSLFSGIGGAEVALHRLGIHMKTVISVEKSEVNRTILKSWWDQTQTGTLIEIADVRHLTTERIETFIRRFGGFDLVIGGSPCNNLAGSNRHHRDGLEGEHSALFYDYIRILEHVKATMSAV

SEQ ID NO: 607 - protein, 592 aa, Brachypodium distachyon
MPQDCISDSDDSAKFEWESDNEAEPSSAPVLRNFDAPGPSTVWQDANGWANGDAPSTSLVEEYVGMGFPKEMVLKAIKEIGHNDANALLELLLTYKVLGEDPTVGNCSTLGCAPQSVEDDDDGDLDSEDWDDEDDADGGEPNFDSSGDEDFLQEMSEHDKKIKSLVDMGFPEDESNMAIVRCGVDAALTVLVDSIYASQAAGDCNSRNSSHHEVCDSFGGRRNKKKRKQYGGGAQGNRPSECHEELMPLPNPMVGFSLPTARLPSVSRRLPKQATGPPFFYYENVALAPKGVWTIISRNLYDIAPEFVDSKYMCATARKRGYVHNLPIENRSPLLPLPPKTIFEAFPHYKKWWPSWDPRRQLNCVQTCVSSAKLTERIQCALARSGDPPPLHVQKYVMHECRKWNLVWVGKNKVAPLEPDEMEYLLGYPRDHTRGIGKTARYKCLGNSFQVDTVAYHLSVLRDIFPNGLNVLSLFTGIGGGEVALHRLGIHMKTVVSVEISEVNRRILRGWWDQTQTGTLIEIPDVQSFTSDKIRSFIRRFGGFDLIIGGSPCNNLAGSNRHHRDGLEGEHSSLFYHYPRILDTVKDVMAGM

SEQ ID NO: 608 - protein, 634 aa, Populus trichocarpa
MDGDSLCGDNDDFDWDSEDEKEIENFASSSSSSLRLPQVETRSSSAEASSSVGSSSGSKMIDHFVKMGFPEKMVAEAIQENCKGEEDEDSILETLLKYSTSSSASSSGSKLFDRFVGMGFAEKMVAKAIKENGEGDADSVLETLLTYAAIGKSPQEQPNNDSDHCSSGHEGSFLDDFSDVDSADDEVITKTVSDEDNKLAFLRRMGYKEADASIAITRCGTEATISELADFICAAQIAKAEDAFFAEDEKKPKHLDKQKKRSFLESDVLEKKRQKGLENGDDEGVRLPNPMVGFGVPTEPGIVTRRTLSEAAIGPPFFYYENVALAPKGVWQTISRFLYDVEPEFVDSKHFCAAARKRGYVHNLPIHNRFPLLPLPPNTIHEALPLTRKWWPAWDERTKLNCLQTCIASAKLTERIRKALEAYEGEPPLHVQKFIMDECRKWNLVWVGRNKVAPLEADEVEMLLGFPRNHTRGGGISRTDRYKSLGNSFQVDTVAYHLSSLKDLFPGGINVLSLFSGIGGAEVALHRLGIRLKNVVSVEISNVNRSIMSCWWEQTNQTGNLIHIEDVQHLTADRLEQLMNMYGSFDLVVGGSPCNNLAGSNRHHRDGLEGKESSLFFDYCRILDVVKNLTSRYS

SEQ ID NO: 609 - protein, 616 aa, Vitis vinifera
MVDPLYFRSGLGHALDGNISGEESDSIDWNTDDELETQNLPPSSSSTLIIPGGEASIASGEASSSTGPSNSKLINHFMGMGFSEKMVVKAIEQDGEGNTDSILEYLLTYSALENCPQELENSPQAEPQVVSDNCSSDYDESFLDDFSDTDSCHENQENINSLSDKEKKLLFLADMGYTVEEASIAMDRCGPDSSVVELTDFISAAQISKAADADLGELSDEEKPRPKHLYKDYNKQKKRKFLDYRLWERKKQRGYEKKLRNEDDEPIRLPNPMVGFGVPAEPCPVFHRTLPEAAVGPPYFYYENVALAPKGVWSTISRFLYDVEPEFVDSKYFCATARKRGYIHNLPIQNRFPLLPLPPLTIYEALPLTRKWWPSWDTRTKLNCIQTCVGSAKLTDRIRKALEEWDGVPPMSVQKYVLDECRKWNLVWVGRNKLAPLEPDEVEMLLGFPRNHTRGGGISRTDRYKSLGNSFQVDTVAYHFSVLKDMFPGGITLLSLFSGIGGAEIALHRLGIPLKNVVAVEISETNRNILRSWWEQTNQRGTLVDIADVQQLNGDRLEQLIHTFGGFDLIVGGSPCNNLAGSNRVSRDGLEGKESALFYDYFRILDLVKCIMGRNQ

SEQ ID NO: 610 - protein, 586 aa, Cucumis sativus
MAGDDFGVEVDNIDWDTEDELEIENIPLGSHASLAFPGVEANMASSSAGPSNSKTVDYFIGMGFSAKMVAKAIEDNGEENTDSILETLLTLSALENSPPKQQHVDTDDSFSDYEGSFLDDFSDLDSDYENEATAKPVSDADNKMTFLVDMGYSEDEAYAAIERCGVHSSFAELTDFISAAQISKAADVLLGDLPVRPKPKNLNGCSKLNKRRHYDDDTWKKKKPRCFEDEDDDTIRLPNPMIGFGVPNELCLTVHRKIPEAAMGPPYFYYENVALAPKGVWNTISRFLYDVEPEFVDSKYFCAAARKRGYVHNLPIHNRFPLLPLPPHTVHEALPLTRRWWPSWDTRTQLNCLQTCIGSARLTDRIRRALEDYDGVRDPPLHVQKFVVEQCRKWNLVWVGKNKVAPLEPDEVEMLLGFPKNHTRGGGISRTDRYKSLGNSFQVDTVAYHLSVLKDMFPGGINLLSLFSGIGGAEVALHRLGIPLKNVVSVDISEVNRNIVRCWWEQTNQKGTLIDLADVQELDADRLQYYMNLFGGFDLVVGGSPCNNLTGSNRYTRDGLEGKESILFYDYFRILDLVKCIATKTE

SEQ ID NO: 611 - protein, 628 aa, Arabidopsis lyrata
MAQDSAGDDDFVDWNTDDDLEIDNFQSSPPSSPIQSRVETLVGVAVTTSSLSSPTETTDLVQMGFSDEIFATLFDMGFPVEMIARAIKETGPNAETSVIIDTISKYSSNCEAGSSKSKAIDHFLAMGFDEEKVIKAIQEHGEENMEAIANALLSCAEAEKLPVVEEEDVIDWSSDDETNYSDILVSDDEKDPNSKENSNQIRSLVRMGFSELEASLAVERCGENVDIAELTDFLCAAKMAREFSEFHTDPEERKPRNDIKKRRLESKKEPRSSVDDEPVRLPNPMIGFGVPNEPGLITHRSLPELARGPPFFYYENVALTPKGVWETISRHLFDIPPEFVDSKYFCAAARKRGYIHNLPINNRFQIQPPPKYTIHDAFPLSKRWWPDWDKRTKLNCILTCTGSAQLTNRIRLALEPYNGEPEPPKHVQRYVIDQCRRWNLVWVGKNKAAPLEPDEMENILGFPKNHTRGGGMSRTERYKSLGNSFQVDTVAYHLSVLKPIFPHGINVLSLFTGIGGGEVALHRLQIRMKLVVSVEISKVNRNILKDFWEQTNQTGVLIEFSDIQHLTNDTIEGLMEKYGGFDLVIGGSPCNNLAGGNRVSRVGLEGDQSSLFFEYCRILEVVRAMRRS

SEQ ID NO: 612 - protein, 1047 aa, Arabidopsis thaliana
MDSAIEISSGSDSDDEVPPQPVWPQTRTRMDPTWLSRRPLPTVDSHARAEHTNQAPPNGASSDTSRPGVSKPFTGNGNTVNSRISSGSGADYVRLSSEQALKRTLPPSFNSPPLPARSGTNNISNASGSRVGVDYERPLSQQALKRTLPPSFNPPPLPSRSGTNNIRNAGGSRFGADYSHPAVSAVGNKSTFGDHYSGAHAEIGIQRGVNGVRILPPSLTHGTSASVLHHAGSSDPMHRFGGGEDRNPDNDERLVYQAALQVLNQPMTESDLPPGTLSVPLMRHQKIALAWMFQKETSSFNCPGGILADDQGLGKTVSTIALILKQKIVSQLKSESSCKQETEALVLDADDESDNAKHESGSHVKPELKVSSNSETSVLSACGNDENDSSDMEKAEDEEANSSTRAFQWKRPAAGTLIVCPASVVRQWARELDEKVSEESKLSVLVYHGSNRTKDPNELAEYDVVVTTYAIVTNEAPNKFLVDEDENDEKNTDRYGLASGFSNNKKRKVVVGASKKSKRRGRKSTNDTSSEPDCGPLGKVGWFRIVLDEAQTIKNYRTQMARSCCTLRAKRRWCLSGTPIQNTIDDLYSYFRFLRYDPYAVYKSFYSTIKVPISRNSCQGYKKLQAVLRAIMLRRTKGTLLDGKPIINLPPKVVNLSQVDFSVAERSFYKKLEADSRSQFKAYADAGTLSQNYANILLLLLRLRQACDHPQLVKRYNSDPVGKVSEAAVRRLPREARSRLINRLESSSAICYECNEPPEKPVVTLCGHIFCYECVLEYITGDENTCPVPRCKQQLARDVVFSESSLRNCTSDDSGCSSSHDNGLDRSVFQKRDFCSSKIKAVLDILQSLSQPDSPNSAQHGQMPSSSRPYDDDDVTIVEPMRLHSSSPSQGAVKTIIFSQWTGMLDLVELRILESGIEFRRLDGTMSLAARDRAVKEFSKKPDVKVMLMSLKAGNLGLNMVAACHVILLDLWWNPTTEDQAIDRAHRIGQTRPVTVTRITIKDTVEDRILKLQEEKRTMVASAFGEEHGGSSATRLTVDDLKYLFMV

SEQ ID NO: 613 - protein, 993 aa, Ricinus communis
MEPIDISSDSDVVIEDDEDFEFETSPVRRPTDSRILPPWAAIATTDSRSSGYGRQTQRDTSPKRPYSSNGSSSNWHSSNGGSSNWHTSQADDSLYAIGNGNAGLPRTVNSRIANVYGTDYEKLSSQQALKRTLPSSLHRSPISSISNSLVEGVSSSQTRDIYGNAYHPAGPSSSHSKGFGRGNYEEAITYVSNGSRTLPPSLMRGKSTPSAQFGLRDPAFHPMAGEEGVAGSDERLIYQAALEDLNQPKVEATLPDGLLSVPLLRHQKIALAWMLQKETRSLHCLGGILADDQGLGKTVSMIALIQMQKFLQLKSKSEDQANKKSEALNLDDDDESGRPGLNEVKQVGEYDDTTSVPEASNSTRVFKRKRLAAGTLVVCPASILRQWAGELDDKVADEAKLTCLIYHGGSRTKDPAELAKYDVVLTTYSIITNEVPKQPLVNEDEADEKDGEKCGLSSEFSINKKMKKTTTVSKKRKKGRKGIDCSSNDYDSGPLARVGWSRVILDEAQTIKNHRTQVARACCSLRAKTRWCLSGTPIQNAIDDLYSYFRFLRYDPYAVYKSFYTTIKVPISRNAIQGYKKLQAVLRAVMLRRTKGTLIDGEPIVKLPPKSTCLTKVNFSTEERAFYTRLEADSRSKFKAYAAAGTVNQNYANILLMLLRLRQACDHPLLVKGLNSDSFGKDSAEMAKRLPNDMVINLLSCLATSSAICRACNDPPEDPVVTMCDHVFCYQCVSEYLTGDDNMCPARGCKELLGPDVVFSEATLRSCMSDNLDAGPKRPEFDERAMVLQNEYSSSKIRAVLEILQSHCQVKSPSPELGGATEYNGSSTAPSSLVIKSIIFSQWTSMLDLVEFSLNQHCIQYRRLDGTMTLGARDRAVKDFNTDPEVTVMLMSLKAGNLGLNMVAACHVILLDLWWNPTTEDQAVDRAHRIGQTRPVTVTRLTIKDTVEDRILALQEEKRRMVASAFGEDASGGSATRLTVEDLKYLFMGRSAP

SEQ ID NO: 614 - protein, 1027 aa, Glycine max
MDSQNGCIYISSSDDDLEEIEDPRRTLPQWATNTEKSSYNGGWSRRDSSSRGANSSNPSSSNVYNHSQVKPQTLPVSSTNTLNHRIARRDEPSYHALNGNTSQQQTVSSRISNIHGADYEKMSSQQAFKRTLPSSLQPSATRALPSSFASDSRLRNLKDNASSSQLHDAYKNRPHGVGPSTSSDRGYIRENFGRGYDEDRFLYQNGGNRILPSPLMLGKVISPQFATSSESAYRSGAGDERAAESDERLIYEAALQDISQPKTEYDLPAGVLSVSLLRHQKIALAWMLQKETKSLHCLGGILADDQGLGKTISMISLILAQRTLQSKSKIDDTCSHKTEALNLDDDDDNGSVDVEKHKNSEESDDIKPSREPSSSTQAPGRKRPAAGTLVVCPASVLRQWARELDEKVGDEKLSVLVYHGGSRTKDPVELAKFDVVLTTYSIVTNEVPKQPLVEEDDIDEKMGERFGLSSEFSVSKKRKKPFNGNKKSKKGGKGIDSSSIECGSGPLAKVGWFRVILDEAQTIKNHRTQVARACCSLRAKRRWCLSGTPIQNTIDDLYSYFRFLKYDPYAVYKSFYNTIKVPISKNTIQGYKKLQAVLRAIMLRRTKGTLLDGKPIINLPPKTIELSKVDFSIEERAFYTKLESDSRSQFKAYAAAGTVSQNYANILLMLLRLRQACDHPLLVKDFDSDPVGKDSVEMAKNLPREMLINLFNCLESTFAICLVCNDPPEEPVITMCGHVFCYQCVSEYLTGDDNTCPSVNCKELIGDDLVFSKATLRSCISDDGGSVSFANSHLCDYSLVQQRDYTSSKIKAVLEVLQSNCKLKISSSDLPNSSGGCRDSPSLDNLHVEDCDSDVRVTKHTRRYSESTTEGPIKAIVFSQWTSMLDLVETSLKQFGIQYRRLDGRMTLGARDKAVKDFNTEPEITVMLMSLKAGNLGLNMVAACHVILLDLWWNPTTEDQAIDRAHRIGQTRPVTVTRITIKDTVEDRILALQDDKRKMVASAFGEDHAGASGTRLTVDDLKYLFMV

SEQ ID NO: 615 - protein, 1033 aa, Zea mays
MNENSAIIISDSDDDSIGSIFDDDDQPASAIARLDQNAEGRIINFEDEDWQRSAPAPPSTKPTENNNGQYRILPASLTNGRHAESSRYTFGSVDRIHPHANPYMAMRPGHSTSSRIDSVVEKHNSSTADANDNNKRVLPSSFSNGNTSKSMHPIVASETRKLPLPLSTKKSPNIGENRMGTNIANGNLQPSSSIMARGTSSTLNTHKVDDDDDVIVYGGSSSHRVLPSTFEATNSNNSEVAKGFETHSRLNPENRVLDYAERAVYQEALQNISREKSEDDLPEGVLAVPLLRHQKMALAWMVSKENSSHCAGGILADDQGLGKTVSTIALIQKQRMEQSKFMFVDSDRLKSEALNLDEDDEGEQTVSNEPKKDQGACSLSTSAGTSAELFVNQPNNVVNKMVETKAERKKKAKVSTSSASTSRSMTRPAAGTLVVCPASVLKQWSNELTDKVSESAKLSVLVYHGGARTKDPRELAKYDVVVTTYTIVANEVPKQMADDDADQKNSEEPSASNKRKPSANMQNKAKKKKKKLKDSNFDLDSGPIARVRWFRVVLDEAQTIKNFRTVVARACCGLRAKRRWCLSGTPIQNAIDDLFSYFRFLKYDPYCTYNSFCTMIKHPIARDAINGYKKLQAVLKVVLLRRTKETVINGKPIINLPPKTINLNKVDFTQEERSFYLMLEERSRQQFKAFAAAGTLKQNYANILLMLLRLRQACDHPILVKGNQSEYGGDGSIEMAKKLPKEVVIDLLAKLEVGSTLCGLCNDTPEDAIVTICGHVFCYQCIHERITTDENMCPAPNCSRTLGLELLFSSGALKICISGKSSSAVASSSSDNESSSISQSSFVSSKIQAAIDILNSIIVMDPLTESYTMESSRSGLGPVKAIVFSQWTGMLDLLELSLNINCIQYRRLDGTMSLNLREKNVKDFNTDPEVRVMIMSLKAGNLGLNMVSACHVILLDLWWNPYAEDQAVDRAHRIGQTRPVTVSRLTVKDTVEDRILALQEEKRTMVNSAFGDDKAGGHATRLTVEDLRYLFRI

SEQ ID NO: 616 - protein, 1314 aa, Medicago truncatula
MADDGFQFSTLFADDDSDDEKLAMDIESFLSVLDEDCVPSESSPEDSSLKDVSPGESGIHDDFLLQNGNSLLDSEHENQGPSSRTCSSPNVFAGGYRDSFSVAESDETCYAERAGVSEHEMPSYSVGTSSNPSLWKDDDYSQIKHVVDDVESEYASHSSIIENVDGTFEDYGTALKDTIGVSRQPENDSCTSFEMPFVDVDIPTHFGNSADSTFCQGSNVPSDFSGYYSSLNCYQGIDVRPVVTGSSGYFPNGVGSEFWKNEEPVRNMKVEKTEFLTDTTNVIGGMDLSTIGRIPFHDSQFMPVNNEYPSFFPGNAKFEDGESVQQSSCVPYISSEGQSFNVKAEGDEMVMPYQNTFHNDNAGLEVKQLPGIFPTTGYQNYDFFKVEDSNAIVTTEDANYYQDLIGETANKFPGNMGNLNFRSLDKSLSIARASIANGNQYNCSMSELESKPSECKSIDSQLSKRSTEGSNDEDDCDVCIIEDISHPAPTSRSAEFNSLNMSQSSRFDYTQPYMAGGTRPKAHDEQYILRAALQDISQPKSEVTPPDGLLAVPLLRHQECGSDGLDLEFKIALSWMVQKETSSLYCSGGILADDQGLGKTVSTIALILKERPPLLKTCNNAQKSVLQTMDLDDDPLPENGLVKKESTVCQDASDRNATTSANLSVHAKGRPSAGTLVVCPTSVLRQWADELHNKVTCKANLSVLVYHGSSRTKDPYELAKYDVVLTTYSIVSMEVPKQPLVDKDDKDDKEKGIYEDHPVPNRKRKCPPSSKSGKKALNSMMLEAAARPLAKVAWFRVVLDEAQSIKNHRTQVARACWGLRAKRRWCLSGTPIQNAIDDLYSYFRFLRYDPYAVYTSFCSTIKIPINRNPSKGYRKLQAVLKTIMLRRTKGTLLDGEPIISLPPKSVELRKVEFSQEERDFYSKLEADSRAQFQEYADAGTVKQNYVNILLMLLRLRQACDHPLLVKRYNSTTLWKSSVETAMKLPREKQLFLLKCLEASLALCGICNDAPEEAVVSVCGHVFCNQCICEHLTGEDNQCPATNCKTRLNMSAVFPKATLNSSISDPACDHLPGSEVEDSEPCSRTQPCDSSKIRAALEVLQSLSKPQCHTSQRSHVQSTSRESSDCSSTSANNGKSISDVPEKKAMFMEKSSNDSVGSLGEKAIVFSQWTGMLDLLEACLKDSSIQYRRLDGTMSVLARDKAVKDFNTLPEVSVMIMSLKAASLGLNMVAACHVLMLDLWWNPTTEDQAIDRAHRIGQTRPVTVLRLTVKDTVEDRILALQQKKRTMVASAFGEDGTSGRQTRLTVDDLKYLFMM

SEQ ID NO: 617 - protein, 1385 aa, Physcomitrella patens
MEYRLVSSPREPVLTSSSIDITSNVHPITFGSDGQVSVLPTTDSVQQTNDNEIVQRALVKFMQDVRSFVRQGNWKESSTGLFHRSSTDCARDPFQVSVAETIGSLEWGIFGSAGMGESRLRGDYSCSELGQDGMGELEGAQNNWREGEADVEDGSEPVRDETDQRDVYLDELLSVIEDDPDSRVLRIPPGLESRSGESCRSCSYDLEFEVYAPLTILVSPQAAPRFQATSAMDEVLETDGTMPLLGPAVSHQELGIAPYAPAVPEGHYGLSLAPSFNHTTSEVFWQRDLNGSGEGFEETSDEVLSLEDTEQDTIQYFPELTGDLDYDRPQQNDGSVLASNCYSERLSPGVSRPSRSTSSSPIAMFDNTSRHGLVFDSPFERNSIVENPRQFTILNGHAIVDLTSDDSDGDEEESELKEIDGRSRGKRKLPHDETEGDRKRLRETANSSYMQNIGTGFPYTQIAKKPCETISFPNRSQSWSPSSLKYSSQLGNLESSVTTATSLKNIPGYESHKTTSARRDTYTSSLTNMAQRSCSGEVSTSYDRGISRVLPGTVARSMAGLVNGMRVAATIDHRLALAMDPVKRSEELAIQAVVQAFSLGDEKEELTPDEDLLTMTLLKHQRIALAWMVNRESGRHEPCGGILADDQGLGKTISTISLILKNRAPILKSGSTSAQSVQLEGSTVDLDAYEDDEDQLLLKKEFENGQWPASALIENGNQLQQDEPKSSQPSSKGRPAAGTLVVCPTSVLRQWAQEIRDKVSIKADVSVLVYHGSNRIKDPHEIAKFDVVLSTYSIVSMEVPKQALPEEKEVDNRRSAFDYGISQFTKPKKDKPEKVKKAKAKGKGAGADGDSSDSGPLARVAWFRVVLDEAQSIKNYRTQVARAVWGLRAKRRWCLSGTPIQNSVDDLFSYFRFLRYSPWGDVYKKFQRDIKDPVGRNPTEGYKKLQAILKPIVLRRTKTSFLDGKPIVNLPQRIVKLQQTEFSLNERSFYSNLETESRAQFQMYAAAGTVQNNYVNILWMLLRLRQACDHPMLVKKCAKSEALQKTTLEAVRKLPPHQRAALIQCLEGGRAICYICQDAPEDPVVSICAHVFCRQCVSEQMNGDDTTCRFPKCKKSLNVSLLYTLSALKDSGVCEESSSLIKEEKSSEPAITELDQSWKTSSKIDAMMNTLQALPKVIVLVEDGKIVKGPKAETLLKAEAVEIDQGETLSSGLPVVSETTVSKIDKVESTEKAIVFSQWTSMLDLLETPLKKSGLCYRRLDGTMSVVARDRAVSDFNTLPEVTVMIMSLKAASLGLNMVAANHVLLLDVWWNPTTEDQAIDRAHRIGQTRTVNVSRFTIKNTIEDRILALQERKRQIVASAFGENSGGEQKNRLTVEDLRYLFRV

SEQ ID NO: 618 - protein, 1255 aa, Sorghum bicolor
MAEEPAVGYDGFEAAGDAGAGGAEDNLSMPLGDFMAFLETEPAPPEEGGEEEEEQEQLQPGVNQGCFEMPANTDGSEDLLQSHEEMFENADLWSNYSHVDTSECHMELSGGEQMIDHTEASPYEFFSNDLQNQSRTSNLDNEHFPRDASNHANVEEVAGPPYEDLSNGLYLRQQTLYSGQTQFQVENNTEGMETQMNTYFSGGISTEHSDLMLGSTGQDGDHFTSMGMFSLTHKTDVPDISCTEFNMGEGTESIRNGNSSCLTMQEAECGGYPHPDCISVDMVDERSLHDLPHGFSQNNEQYEMEQFPQSICESGSMQMGSPDQYCDDTSLSDFYMDVSSPESISCEQNQSEDICFKSESSTDSSPIPSSRNSTTEDADKYLGQTSKQLLDSKIVPFSNQHTFKNMGYQKPLALHKQYAYRSDNSSIHNSSRGCFNRDGDGASDLCVLEGNRNPAPDHRLPYQGKFHHNFQQHMYSNSMIPAFGGMRYKPHDERITLRLALQDISQPKSEANPPDGVLAVPLLRHQKIALSWMVQKETSSSHCSGGILADDQGLGKTVSAISLILTERSPVPQSSTIKNEPCEAVTLDDDDEDDSVEPHPKKLMQTCSSKVTTNTVKQENPFVAIKTRPAAGTLVVCPTSVLRQWAGELKNKVTSKANLSFLIYHGSNRTKDPNELTKYDVVLTTYSIVSMEVPKQSNPDSDDEEKGKPDRYGAPVSSSGSKKRKAPSKKTKCKSAAESCLPEKPLAKVAWFRVILDEAQSIKNYRTQVARACWGLRAKRRWCLSGTPIQNAVEDLYSYFRFLRYDPYAVYKQFCTMIKIPISRNPTNGYKKLQVVLKTVMLRRTKATMLDGKPIISLPPKTVSLKTVDFTGEERAFYNTLEVESREQFKEYAAAGTVKQNYVNILLMLLRLRQACDHPHLVRGYNSSSSWMSSLEMAKKLPMERQHELLNCLQSCSALCALCNDAPEDPVVTICGHVFCNQCILEQLTGDDSVCPVSNCRVRLNTTSLFSRGTLECSLSRLTCDFKSDDDTCMEMIHAEKRPGIDSSYASSKVRAALDILLSLPRIDPTQMTDSKCSIGLESEKFDGRGTSEQIDTKLTEKAIVFSQWTRMLDLLEVHLKASHVTYRRLDGTMSVAARDKAVKDFNTVPEVTVMIMSLKAASLGLNMVAACHVLMLDLWWNPTTEDQAVDRAHRIGQTRPVTVSRLTIKDTVEDRILALQEKKREMVASAFGEDKSGSRQTRLTVEDLNYLFMV

SEQ ID NO: 619 - protein, 1030 aa, Oryza sativa
MLAGNMNNDNYIDLSSDSDIDFDFDSDDSVGGLDQELASSSSRPTENINGQYRTLPPSFTNGRHVDNARHALGSGDRAYPHSSSYRGSPNDSARATPASNRTDIVVKKHNGFASEENDNGKRILPSSFSNGRTTNAMHPVVASETRKFPPSFTNGNSQRLAENRMGKNVANGIGEPSSSRFPSRSSFGTDNKKVITDSDNEDVYVYGSSSSHRVLPPSFGRNSSANHSEFANGIDMQGRLNLENRIIDSDERAVYQEALQNIIQDKREDDLPEGVLSVPLLRHQKMALAWMVSKENSSHCAGGILADDQGLGKTVSTIALIQKQRIQQSKFMSVDSDRLKAEALNLDDDDEAAPVADNKGEQTKNDEPRKDLGAGSSSTAAGTGDVETCASLMNTAPDKTVERNVERKKKSKASTSSTMQSMTRPAAGTLVVCPASVLKQWANELTDKVGESAKLSVLVYHGGSRTKDPNELAKYDVVITTYTIVANEVPKQNADDDTDQKNGEESSAGNKRKQPPKAQSKSKKKKKKLKDSDIYLASGPVARVRWFRVVLDEAQTIKNFRTQVAKACCGLRAKRRWCLSGTPIQNAIDELYSYFHFLKYDPYSTYNSFCTMIKHPIARNAVHGYKKLQTVLRIVLLRRTKETLIDGEPIIKLPPKTINLDKVDFTKEERAFYLTLEERSRQQFKAYAAAGTLKQNYANILLMLLRLRQACDHPLLVKGHQSEYKGDGSIEMAKQLPKEMIINLLAKLEVGEFCSVCSDVPEDAVVTMCGHVFCYQCIYERITTDENMCPSPNCGNTLSTDSVFSSGALRICMSGVSSSHASGSSSLDDESSSISQTSYISSKIQAAIDILNSIINTYALTDSDTVESNPSRVAPVKAIVFSQWTGMLDLLELSLNSNLIQYRRLDGTMSLNSRDKAVKDFNTDPEVRVMIMSLKAGNLGLNMVAACHVILLDLWWNPYAEDQAIDRAHRIGQTRPVTVSRLTIKDTVEDRILALQEEKRAMVSSAFGEDKSGGHATRLTVDDLKYLFRF

SEQ ID NO: 620 - protein, 1070 aa, Brachypodium distachyon
MLASNMNNDNDNVIDLISDSDDDFDFDSDDPTSTSVTSVRNGEGQPIRLQDEDLARTMLSTPSSSRPLKNSNGQYRTLPPSFANGIEPLKNSNGQYRTLPPSFANGIDIKKARYTRGSGDRTYPHSSSYVGSPYDSARATLTSNRIASVVKELNGSALDANDNDKMILPSSFSNGSTAKSINPNVASDSRRLPSRFANGNSQKMVENMMESNDAKQIGQPSSSKFPTQNLSLSNAQKVITDDDDDDDIYVYGGTSSNRVLPSSFGGNNSANNTDLVNGNGMQARPNLESRFLDSEERAVYQEALQNISLDKKEDDLPEGYLSVSLLKHQKMALAWMVSKENSSHCAGGILADDQGLGKTVSTIALIQKQRIPQSKFMSADSDALKSEALNLDEDDETVTVVDKGEQILNNEPKELGASLSSTAASISGVKPCISEIEVPDRMAESKVECKKKTKTGTSSASSMHSMTRPAAGTLVVCPASVLKQWANELTDKVGESAKLSVLVYHGGARTKNPSELAKYDVVVTTYTIVANEVPKQNADDDPDQKNAEESSAGNKTKPSSKSKKRKKKLKDSDIDLNSGPVARVRWFRVVLDEAQTIKNFRTQVAKACCGLRAKRRWCLSGTPIQNAIDELYSYFRFLKYDPYSTYSSFCTMIKHPIARDAVHGYKKLQTVLRIVLLRRTKETKINGEPIINLPPKTINLNKVDFTKEERAFYSTLEERSQQQFKEYAAAGTLNQNYANILLLLLRLRQACDHPLLVKGHQSVFKGDGSIERARQLPKDLVIDLLAKLEVSSLCAVCRDTPEDAVVAMCGHIFCYQCIHERITTDENMCPTPNCRTTLSTESVFSSGTLRICIAGNTCTYATASSSADDELSSISQSSYMSSKIRATVDELNTIINTHAITDSDTSESNPSQVAPVKAIVFSQWTGMLDQLELSLNNNLIRYRRLDGTMSLNLRDRAVKDFNTDPEVRVMIMSLKAGNLGLNMVAACHVILLDVWWNPYAEDQAIDRAHRIGQTRAVTVSRLTIKDTVEDRILALQEEKRAMVNSAFGEDKSGGHATRLTVEDLRYLFRI

SEQ ID NO: 621 - protein, 1327 aa, Populus trichocarpa
MIMADGRSGSVMPGGEIMAVGDGNSGDGEEEDLSMDVDLFYTILGEEPSPASPKIEGADGLGGESMDHAAYSLHNPEGSDARAGHLGGSIDYTGRQMSSLMHARSGSSREFCFPFQKDQGTMRAGASQSEIASCITEPTTFADGVSSCVADHAGSSHGPRMDGLDEKFGSRDALDNDSLGILELKTDIHRSMVMPLMDTDHDMISTKSADWHYPGFNSELRDHDSAMQFGMNGYDAHYTDSSGFDFSSDFNFGLFPINQEINEFQPENACSGPEISMMPCSDVNGMNFKSEGDGYTFPKTRKFSSSADDGLNHDKASVMPPSDIQLGISEVQTVCVEDEKTDGLVACRNMTWQTGEGVTEAVDRKCSWSDGNGTFVYKDKQQSPSGVLSSVQSQKHVIYTNDDRGGMALGSSRAQVEGIAGRFPFDSVYLNLSASEQYLPFAPTSHLSKMQLGCGKDEKQGLPIHSKALGSHLSIVSPESIQSNSSGSKSHVDDEPDICILDDISQPARSNQCFAPSKPIVPLLHPTYNDSLHHSTVEGTRFKANDEQLVLRVALQDLAQPKSEAVPPDGFLAVPLLRHQRIALSWMVQKETSSLHCSGGILADDQGLGKTVSTIALILKERAPLCRVDAVAVKKEECETLNLDDDDDGVIEIDRLKKGADGSQVKSNRSSTKSLNSPGQSKGRPAAGTLIVCPTSVLRQWADELHTKVTTEANLSVLVYHGSNRTKDPSEVAKYDVVVTTYSIVSMEVPKQPLADEDEEKQRMEGDDVPHLGLSYGKKRKYPPTSGKKGLKNKKGMDSAMLESIARPLAKVAWFRVVLDEAQSIKNHRTQVARACWGLRAKRRWCLSGTPIQNAIDDLYSYFRFLRYEPYAVYKLFCSAIKVPIQKNPAKGYRKLQAVLKTVMLRRTKGTLLDGEPIINLPPKVVELKKVDFTEEERDFYTRLEIDSRAQFKEYAAAGTVKQNYVNILLMLLRLRQACDHPLLVKGLDSNSLGGSSIEMAKKLPQEKQLCLLKCLEASLAICGICSDPPEDAVVSVCGHVFCKQCICEHLTGDDNQCPVSNCKVRLNVSSVFSKATLNSSLSDEPDQDSSGSELVAAVSSSSDNRPHNSSKIRATLEVLQSLTKPKDCLSKCNLSENSADGNVACHETSSGSTGSLNDGTDKRHPPAKVVGEKAIVFSQWTGMLDLLEACLKSSSIQYRRLDGTMSVVARDKAVKDFNTLPEVSVMIMSLKAASLGLNMVAACHVLLLDLWWNPTTEDQAIDRAHRIGQTRKVTVLRLTVKNTVEDRILALQQKKREMVASAFGEDENGGRQTRLTVDDLNYLFMV

SEQ ID NO: 622 - protein, 1013 aa, Vitis vinifera
MDPIDITSSSDSDFDFEDDRETDTSPVGESVAFANSRILPPWPSTSGTNSKSTSHGHFQKVPSPKRASASNGSSSNFYHYPPKIQMHPSFDDDIRASNRHNFREADFNYSTENGDMLDVENHQQLINLNKADIFGADYEKLSQPAMRRTLPSTLQPSAPSAGMNNTVGNIGSSHIHDSQGKSFHPVGPILNNMNYMKEHFGRGNDDEVIMYENSGSRILPPSLMHGKSVPSTQYGGVSESAYRPGVAEEMAANTDERLVYQAALQDLNQPKVEATLPDGLLTVSLLRHQKIALAWMHQKETRSLHCLGGILADDQGLGKTVSMIALIQMQKSLQSKSKSEELHNHSTEALNLDDDDDNANAAGSDKGKQTEETSDSKPISEVSASLPEFRRRRPAAGTLVVCPASVLRQWARELDEKVSEEAKLSVCLYHGGSRTKDPVELAKYDVVLTTYSIVTNEVPKQPLVDDDEGDERNGEKYGLSSEFSVNKKRKKPSNVSKRGKKGRKGIDSSSIDYDCGPLARVGWFRVILDEAQTIKNHRTQVARACCSLRAKRRWCLSGTPIQNAIDDLYSYFRFLKYDPYAVYKSFYNTIKVPISRNSVHGYKKLQAVLRAIMLRRTKGTLIDGTPIINLPPKTICLSKVDFSSEERAFYSKLEADSRSQFKEYAAAGTVNQNYANILLMLLRLRQACDHPLLVKGYNTDSIRKVSSEMAKKLPSDILINLLDILETSAICRVCNDPPEDAVVTMCGHVFCYQCVSEYLTGDDNTCPALECKEQLGADVVFSKATLISCISDELDGSLSNSSQSAEKSINLQNEYSSSKIRAALEILQSHCKLTSPDSDPHSSMGCNGSYSNPETEGPIKAIVFSQWTSMLDLVEMSMNHSCIQYRRLDGTMSLASRDRAVKDFNTDPEVTVMLMSLKAGNLGLNMVAASLVILLDLWWNPTTEDQAVDRAHRIGQTRPVTVSRITIKDTVEDRILALQEDKRKMVASAFGEDQTGGSATRLTVEDLKYLFMV

SEQ ID NO: 623 - protein, 1286 aa, Cucumis sativus
MVISDDLINQSPLLSIAGEVLGFQTFLIRFCFQTSLFAGLCVFSGFSLMIILMADEASNFPLQYADDDFDEDMSMEYEKILHLLSEDLDPLQIKTEDLSPNNASTGQPAFDSSNQENFQLQNDISHGFMDVTLKNHDSLDGKGTETLRSSENNSCASVELPSFDAEHSSKEVFPTESTVNPSFDFVTDVTNSYSTMPYWMSTVEQPFLVSSQYLFPGDYDSPLVSGNGDMTVNMMHDVEFPSNSLCSSTTMDLYAQGATDHKSVSRESVSKDLILDRYSNVKRWDQNCESGNFISSFDGKYPFHVDNLHIGQASMGIPMSTELNSSCKELVSQMKNETMDSLVESCSGPWQSMMEENLFFQSQRVFRSEDMVCGTSGRLSNDGRYQNLYITDQYSPNGHSSNLSNQPLVFIKDDRDHKLSVRKSDIDHPQVSPESTHSNLSDRAHVEDDPDICIIEDMSHPAPSNRSLMVGKSVASQSFSIVSGSSTYMGIGSLRQKAKDIDILKVALQDLSQPKSETSPPDGALDVPLLRHQRIALSWMVQKETSSVPCAGGILADDQGLGKTISTIALILKERAPIRACPTVKHEELETLNLDEDDDIHPEHDGPKQEFSHQVSPSKDLTLSKNTSVQAKGRPAAGTLVVCPTSVLRQWADELHNKVSSKANLSVLVYHGSSRTKDPCELAKYDVVLTTYSIVSMEVPKQSVVDEEDDEKHNTEEQAILPSHLSSSKKRKNFSGSDKKHSKNKKGVDNEVFESVARPLAKVRWFRVVLDEAQSIKNHKTQVARACWGLRAKRRWCLSGTPIQNAIDDLYSYFRFLKYDPYAAYKSFCSAIKFPINKNPAKGYKKLQAILRTIMLRRTKATLLDGQPIVTLPPKHVELKKVDFTEEERDFYSKLEADSRAQYEEYAAAGTVKQNYVNILLMLLRLRQACDHPLLVKPYDSKSLWRSSADVAKKLPRDKQIFLLNCLEASLAICGICNDPPEDGVVSECGHVFCKQCILEHLSSDDCQCPTGGCKVHLNASLLFSKSSLCNSNSDQLGEDNSVVSSCSTVGDSMELSSSVMYESSKIKAALEVLMSLAKPKEYSRNTSPELAVVGASEKSMDASSTELRLESSECQDSTNKSSCELVKRGGEKAIVFSQWTGMLDLLEACLKNSSIQYRRLDGTMSVLARDKAVKDFNNLPEVSVMIMSLKAASLGLNMIVACHVLLLDLWWNPTTEDQAIDRAHRIGQTRPVTVLRLTVRDTVEDRILALQQKKREMVSSAFGEDEAGGRQTRLTVEDLNYLFMM

SEQ ID NO: 624 - protein, 1046 aa, Arabidopsis lyrata
MDSAIEISSGSDSDDELPQPIRPQIRTRTDPIWLGIEIVPTVDSHARAEHTNQASRNSASNDTSRPGVSKPFTGNGNTVNSRISSGSGADYERLSSEQAPKRTLPPSFSSPPFPSRSGANNISNASGSRVGADHERLSSQQAPKRTLPPSFNPPPLPSRSGTNNISNASGSRFGADYSRPAVSAVGNKSTFGDHYSGAHAEIGIQRGMNGVRILPPSLTHGTSASVLHHAGSSDPMHRLGTGEDRNPDNDERLVYQAALQDLNQPITESDLPPGVLSVPLMRHQKIALAWMFQKETRSFNCAGGILADDQGLGKTVSTIALILKQKIVSQLKSANSCKQETEALVLDADDESDNAKHENGSHVKPELKVSSNSETSVLSASGNDENDSSDMEKAKDEEANSSTRAFKWKRPAAGTLIVCPASVVRQWARELDEKVSEEWKLSVLVYHGSNRTKDPNELAEYDVVVTTYAIVTNEAPKKFLVDEDENDEKSTDEYGLASGFSNNKKRKVAVGASKKSKKRSRKSTDNSSSEPDCGALGKVGWFRIVLDEAQTIKNHRTQVARSCSTLRAKRRWCLSGTPIQNTIDDLYSYFRFLRYDPYAAYKSFYSTIKVPISRNSCQGYKKLQAVLRAIMLRRTKGTLLDGKPIINLPPKKVNLSTVDFSVEERSFYRKLEADSRSQFKAYADAGTLSQNYANILLMLLRLRQACDHPQLVKVYNSDPVGKESEAAVRRLPREARSRLINRLESSSAICYECNEPPEKPVVTLCGHVFCYECVLEYITGDENMCPVPRCKQQLARDVVFSESSLRNCISDDLGCSSSHDKGLDRSVFEKREFCSSKIKAVLDILQSLSKQDTPNSAQHGQMPSSSGPYDDDDVTIVEPMRLHSSSPSQGAVKTIIFSQWTGMLDLVELRILESGIEFRRLDGTMSLAARDRAVKEFSKNPDVKVMLMSLKAGNLGLNMVAACHVILLDLWWNPTTEDQAIDRAHRIGQTRPVTVTRITIKDTVEDRILTLQEDKRTMVASAFGEEHGGSSATRLTVDDLKYLFML

SEQ ID NO: 625 - DNA, 1995 bp, Artificial Sequence; identical to SEQ ID NO: 452
  Synthetic Construct

SEQ ID NO: 626 - DNA, 121 bp, Artificial Sequence
  Synthetic Construct
ggatcatcaacaagtttgtacaaaaaagcaggctctttaaagtatttttacaacaattaccaacaacaacaaacaacaaacaacattacaattactatttacaattacaaaaaaagttacc

SEQ ID NO: 627 - DNA, 4098 bp, Artificial Sequence
  Synthetic Construct
atggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggc

SEQ ID NO: 628 - DNA, 33 bp, Artificial Sequence
  Synthetic Construct
ggagactacccgtatgacgtgcccgattacgct

SEQ ID NO: 629 - DNA, 249 bp, Artificial Sequence
  Synthetic Construct
gccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaa

SEQ ID NO: 630 - DNA, 39 bp, Artificial Sequence
  Synthetic Construct
ggcgggtcaggcggaggcgggagcggaggcgggggcagc

SEQ ID NO: 631 - DNA, 1065 bp, Artificial Sequence
  Synthetic Construct
gagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattag

SEQ ID NO: 632 - DNA, 744 bp, Artificial Sequence
  Synthetic Construct
cctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 633 - DNA, 6 bp, Artificial Sequence
  Synthetic Construct
aagctt

SEQ ID NO: 634 - DNA, 17902 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaccatggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccagcggcggcgggtcaggcggaggcgggagcggaggcgggggcagccccgggggcgcgccaagctatcaaacaagtttgtacaaaaaagcaggctccgcggccgcccccttcaccgagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattaggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagtctaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgactcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaccgcggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagaatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatggcgccggcggtcgagggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgtcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgttattctaataaacgctcttttctcttaggtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgggtaccgggccccccctcgaggcgcgcc

SEQ ID NO: 635 - DNA, 473 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattg

SEQ ID NO: 636 - DNA, 77 bp, Artificial Sequence
  Synthetic Construct
aacaaagcaccagtggtctagtggtagaatagtaccctgccacggtacagacccgggttcgattcccggctggtgca

SEQ ID NO: 637 - DNA, 21 bp, Artificial Sequence
  Synthetic Construct
gacggaaagatgtatgggctt

SEQ ID NO: 638 - DNA, 76 bp, Artificial Sequence
  Synthetic Construct
gttttagagctagaaatagcaagttaaaataaggctagtccgttatcaacttgaaaaagtggcaccgagtcggtgc

SEQ ID NO: 639 - DNA, 77 bp, Artificial Sequence; identical to SEQ ID NO: 636
  Synthetic Construct

SEQ ID NO: 640 - DNA, 19 bp, Artificial Sequence
  Synthetic Construct
aaactaggccatccatgga

SEQ ID NO: 641 - DNA, 7 bp, Artificial Sequence
  Synthetic Construct
ttttttt

SEQ ID NO: 642 - DNA, 793 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgaacaaagcaccagtggtctagtggtagaatagtaccctgccacggtacagacccgggttcgattcccggctggtgcagacggaaagatgtatgggcttgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaaaactaggccatccatggagtttaaacaaacaaactttttttaaaccaccccgtgtcaacgcggc

SEQ ID NO: 643 - DNA, 473 bp, Artificial Sequence; identical to SEQ ID NO: 635
  Synthetic Construct

SEQ ID NO: 644 - DNA, 77 bp, Artificial Sequence; identical to SEQ ID NO: 636
  Synthetic Construct

SEQ ID NO: 645 - DNA, 20 bp, Artificial Sequence
  Synthetic Construct
gcggcgcaagatctgatatt

SEQ ID NO: 646 - DNA, 76 bp, Artificial Sequence; identical to SEQ ID NO: 638
  Synthetic Construct

SEQ ID NO: 647 - DNA, 77 bp, Artificial Sequence; identical to SEQ ID NO: 636
  Synthetic Construct

SEQ ID NO: 648 - DNA, 20 bp, Artificial Sequence
  Synthetic Construct
ccattggtccaagtgctatt

SEQ ID NO: 649 - DNA, 76 bp, Artificial Sequence; identical to SEQ ID NO: 638
  Synthetic Construct

SEQ ID NO: 650 - DNA, 77 bp, Artificial Sequence; identical to SEQ ID NO: 636
  Synthetic Construct

SEQ ID NO: 651 - DNA, 20 bp, Artificial Sequence
  Synthetic Construct
attctcgacggaaagatgta

SEQ ID NO: 652 - DNA, 76 bp, Artificial Sequence; identical to SEQ ID NO: 638
  Synthetic Construct

SEQ ID NO: 653 - DNA, 77 bp, Artificial Sequence; identical to SEQ ID NO: 636
  Synthetic Construct

SEQ ID NO: 654 - DNA, 20 bp, Artificial Sequence
  Synthetic Construct
aaaactaggccatccatgga

SEQ ID NO: 655 - DNA, 76 bp, Artificial Sequence; identical to SEQ ID NO: 638
  Synthetic Construct

SEQ ID NO: 656 - DNA, 7 bp, Artificial Sequence
  Synthetic Construct
ttttttt

SEQ ID NO: 657 - DNA, 1223 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgaacaaagcaccagtggtctagtggtagaatagtaccctgccacggtacagacccgggttcgattcccggctggtgcagcggcgcaagatctgatattgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaccattggtccaagtgctattgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaattctcgacggaaagatgtagttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaaaaactaggccatccatggagttttagagctagaaatagcaagttaaaataaggctagtccgttatcaacttgaaaaagtggcaccgagtcggtgcgtttaaacaaacaaactttttttaaaccaccccgtgtcaacgcggc

SEQ ID NO: 658 - DNA, 1992 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgt

SEQ ID NO: 659 - DNA, 630 bp, Artificial Sequence
  Synthetic Construct
ccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggac

SEQ ID NO: 660 - DNA, 97 bp, Artificial Sequence
  Synthetic Construct
tcgaggactacaaagacgatgacgacaaagactacaaagacgatgacgacaaagactacaaagacgatgacgacaaaaagcttgatatcgccatggg

SEQ ID NO: 661 - DNA, 1161 bp, Artificial Sequence
  Synthetic Construct
atgtcaaaagtagaaaacaaaacgaaaaagctaagggtattcgaagctttcgcggggataggggcgcaaaggaaggcactagaaaaagtccgtaaggacgagtatgagatcgtcgggcttgccgagtggtatgttcctgcaatagtgatgtaccaagcaatccacaataattttcacacgaaactagaatataagtcagtctcaagggaagagatgatcgactatctggagaacaagacgctgtcctggaactctaaaaatcctgtatcaaacggatactggaagcgaaagaaggacgacgaacttaagattatatacaacgcgattaaattatcagaaaaagagggaaatatcttcgacattagggatttgtacaaaagaaccctcaagaatattgatttgctcacctatagtttcccgtgtcaagacctgtcccaacagggcatacaaaaaggcatgaaacgtggcagcggtacaagaagtggactcctgtgggaaattgagagggctctagatagcacagagaaaaacgatttaccaaaatatctactcatggagaacgtgggcgccctgcttcataaaaaaaacgaggaagaattgaatcagtggaaacaaaagctggaatctttaggttatcagaactcaatcgaagttttgaacgccgccgatttcggttcctcacaagcacgaagaagggtttttatgatttccactcttaatgagttcgttgaacttccgaagggtgataaaaaacccaaaagtatcaaaaaagtcctcaataagatagtctcagagaaagatattctaaataaccttctgaaatataacttaactgagttcaagaaaacgaaatctaatatcaataaagccagtcttatagggtattctaagttcaactctgaaggatacgtgtatgaccccgagtttacgggaccgacgttaactgcttccggcgcaaattcacgaatcaagatcaaggatggttccaatatccgtaaaatgaactctgatgagacgtttttgtacattggattcgactcacaagacggaaagagggtcaatgagatcgagtttctaaccgaaaaccaaaagatttttgtttgtggaaactccatttctgtagaagtcctggaagcaatcattgataaaatagggggataa

SEQ ID NO: 662 - DNA, 739 bp, Artificial Sequence
  Synthetic Construct
ctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacg

SEQ ID NO: 663 - DNA, 4782 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgtccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgaggactacaaagacgatgacgacaaagactacaaagacgatgacgacaaagactacaaagacgatgacgacaaaaagcttgatatcgccatggggggcgcgccaagctatcaaacaagtttgtacaaaaaagcaggctccgcggccgcccccttcaccatgtcaaaagtagaaaacaaaacgaaaaagctaagggtattcgaagctttcgcggggataggggcgcaaaggaaggcactagaaaaagtccgtaaggacgagtatgagatcgtcgggcttgccgagtggtatgttcctgcaatagtgatgtaccaagcaatccacaataattttcacacgaaactagaatataagtcagtctcaagggaagagatgatcgactatctggagaacaagacgctgtcctggaactctaaaaatcctgtatcaaacggatactggaagcgaaagaaggacgacgaacttaagattatatacaacgcgattaaattatcagaaaaagagggaaatatcttcgacattagggatttgtacaaaagaaccctcaagaatattgatttgctcacctatagtttcccgtgtcaagacctgtcccaacagggcatacaaaaaggcatgaaacgtggcagcggtacaagaagtggactcctgtgggaaattgagagggctctagatagcacagagaaaaacgatttaccaaaatatctactcatggagaacgtgggcgccctgcttcataaaaaaaacgaggaagaattgaatcagtggaaacaaaagctggaatctttaggttatcagaactcaatcgaagttttgaacgccgccgatttcggttcctcacaagcacgaagaagggtttttatgatttccactcttaatgagttcgttgaacttccgaagggtgataaaaaacccaaaagtatcaaaaaagtcctcaataagatagtctcagagaaagatattctaaataaccttctgaaatataacttaactgagttcaagaaaacgaaatctaatatcaataaagccagtcttatagggtattctaagttcaactctgaaggatacgtgtatgaccccgagtttacgggaccgacgttaactgcttccggcgcaaattcacgaatcaagatcaaggatggttccaatatccgtaaaatgaactctgatgagacgtttttgtacattggattcgactcacaagacggaaagagggtcaatgagatcgagtttctaaccgaaaaccaaaagatttttgtttgtggaaactccatttctgtagaagtcctggaagcaatcattgataaaatagggggataaaagggtgggcgcgccgacccagctttcttgtacaaagtggttcgataattccttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 664 - DNA, 1992 bp, Artificial Sequence; identical to SEQ ID NO: 658
  Synthetic Construct

SEQ ID NO: 665 - DNA, 630 bp, Artificial Sequence; identical to SEQ ID NO: 659
  Synthetic Construct

SEQ ID NO: 666 - DNA, 97 bp, Artificial Sequence; identical to SEQ ID NO: 660
  Synthetic Construct

SEQ ID NO: 667 - DNA, 1065 bp, Artificial Sequence
  Synthetic Construct
gagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggatccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattag

SEQ ID NO: 668 - DNA, 739 bp, Artificial Sequence; identical to SEQ ID NO: 662
  Synthetic Construct

SEQ ID NO: 669 - DNA, 4686 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgtccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgaggactacaaagacgatgacgacaaagactacaaagacgatgacgacaaagactacaaagacgatgacgacaaaaagcttgatatcgccatggggggcgcgccaagctatcaaacaagtttgtacaaaaaagcaggctccgcggccgcccccttcaccgagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggatccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattagaagggtgggcgcgccgacccagctttcttgtacaaagtggttcgataattccttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 670 - DNA, 1065 bp, Artificial Sequence; identical to SEQ ID NO: 667
  Synthetic Construct

SEQ ID NO: 671 - DNA, 14414 bp, Artificial Sequence
  Synthetic Construct
  misc_feature 157, 158, 159, 160, 161, 162, 163, 164, 165, 166, 167, 168,169, 170, 171, 172, 173, 174, 175, 176: n = A,T,C or G
ggtttcagaattcaaaaaaagcaccgactcggtgccacttggccctgcagacatgggtgatcctcatgttggccaagttgataacggactagccttattttaacttgctaggccctgcagacatgggtgatcctcatgttggcctagctctaaaacnnnnnnnnnnnnnnnnnnnncaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacctcgtcgcaaaattcgccctggacccgcccaacgatttgtcgtcactgtcaaggtttgacctgcacttcatttggggcccacatacaccaaaaaaatgctgcataattctcggggcagcaagtcggttacccggccgccgtgctggaccgggttgaatggtgcccgtaactttcggtagagcggacggccaatactcaacttcaaggaatctcacccatgcgcgccggcggggaaccggagttcccttcagtgagcgttattagttcgccgctcggtgtgtcgtagatactagcccctggggcacttttgaaatttgaataagatttatgtaatcagtcttttaggtttgaccggttctgccgctttttttaaaattggatttgtaataataaaacgcaattgtttgttattgtggcgctctatcatagatgtcgctataaacctattcagcacaatatattgttttcattttaatattgtacatataagtagtagggtacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcaggactctagggactagtcccgggtcttaattaactctctagactcacctaggagctccaccgcggtggcggccgctctagaactagttaattaagaattatcgaaccactttgtacaagaaagctgggcccatgaggccctaatgtttatgtctggacattatggacttgaccaagtccaatatccgaacatagtcataaaatagggaagactctttgccttcaagcccatccctgctcactctgttactgcctgcaaggttattgcacgggcttccaccaattaccaaatcaaatcctccaaatgactctatcagttgctccaagcggtctccattcagctgctgcacatcgttaaaatgtataaggttccctctctgattagtttgctcccaccagcttctcacaatatccctgttgacttcagatttttccacagaaaccactgtgtttagtggaataccaagacgataaagagcaacttcaccaccgccaattccagagaagagtgataagacattgataccaccgggaaacaagtctttcaataccgacaaatggtatgccacagtgtcaacctggaatgaattaccaagcgacttgtatctatcggtcctacttataccacctcccctagtatggttctttggaaatcccagtagcatttcaacttcatcaggctccaaaggagcaactttgtttctcccaacccacaccaaattccacttccgacattgatcaagaacaaacttctgaactctcattggtggctcaccatcaaagtcctccacagctttcctaatcctattcgtcaattgtgcacttccaatggctgtttgcaaacaatttaactttgtccgtggatcccaagatggccaccatttcttcgataggggaagtgcctcatgaatggtacgtggggcaagtggaaacaaaggaaatctattttcaaccggcagattatgaatataacccctttttcttgcagcagcacaaaaatatttggagtcgacaaactctggctcaatatcgtacaaaaatctagaaattgtgtcccacacaccctttggagctagagccacattttcatagtagaaaaacgggggtccaacagcttgctcgggaagagttcttcgaaccattgctggaagtggttcggtaggaaccccaaacccaatcataggtttgggcaaacgaattgtctcggtgaagggggcggccgcggagcctgcttttttgtacaaacttgtttgatagcttggcgcgcccttgtcatcgtcatccttgtagtctttatcgtcatcgtctttataatccgccaccttcctctttttcttaggtccgctacctcctcctccgcttcctcctcctccgcttccacctcctccagcgctgtagatacctgagttagcggcgatggcggaagggataggattaccgtctttgaggagcccctgcattgccttcacgatgagttcacagtcagaattggtagcgaaaattgggatagtgagctccatgttcaggtaggacctccaagcggcgacaggcagttcgactccgcccactgtctgggtagccactttggggacctccaccttgatggtatactttctcttctgggcactagactgcctgacgctgcatgtcaccttgtaggcctggctccgtgagttggagctgatccactctgccaccccattagcgaaattagaaggagccactgtcacatcccctgtcccaccattgtccacgagcacgaactgagtaaagtttgaagccatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactacgcaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaaaaaatacagcattgggttggacattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgttcaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgaccatatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggc

SEQ ID NO: 672 - DNA, 1457 bp, Artificial Sequence
  Synthetic Construct
gaaggttctcatcatataccgaaagaatgggaaatttgaaaattccatacttttttaaaaagacaatttgttttatcactttagtttttttatatattcagcgtctaccaaatctacacttttttttctttctcgatttagttaatcttcgttcttgtgtcatgtaatagattactatttcaaaacatagatatttagttatctaaataaaactaggccatccatggatggtttcaattttttttttcatatgaaagaaaagttaaatttcatttcacaataaccattgattactaaatttagtaaagaatcaattgggtttagtgtttacttgtttaaggttttttttttttcttttgttatggttctatactaatatcaaagagttatgggccgaagcccatacatctttccgtcgagaatctcatatattctttatcgaagcccatacatctttccgtcgagaatctcatatataccttatcccattcaacattcatacgagcgccgctctagggtttttgcttttcgccattggtccaagtgctatttggttgtttaaggttgcttttagcacacaactttaatattatttttatgtttttcttcttacgatttatcgatttgtgggatactgacaatcagattattgttgttttttccagccaaatatcagatcttgcgccgctctttatcccattcaacattcatacgagcaccgctttacggtttttgcttttcgacattggtcgaagtgctatttggttgtttaaggttgcttttagcacacaactttaatattatttttatgttttcttcttacgatttatcgatttgtaggatactgacaatcagatttttgttgtttttttcagccaaaaatcagatttttttacattttgtttagagaatgattttggttcccgatttgtctgtttttcgcttatgtgtaaagtactttgaaaaatattgtgttaactctacaatgggtatcccaaatttttgagttcttttgtcttgttcgttgtcgagacactagaaatgttaatttaattctcttcttccaaaaagaaccatttactggttcattctctacttgaattttattctggttgtatttcttttccagtataaagcagattgttttttgttatttttcagtttagattggctttgtctcttttgagttgttgcaattgtcaaactttggaatgaaatagtaaataatcttaggttggtagtaaatcttaacattgtgtttttggggcataatttatcgataaaatcttcagcattaaaaccaaaaagaaaaaactttttaagtcttttttgtttggtggttaatataaagtttatacgtgtattaatttgatcacactcactatatgtccagggagctaaacctctatatcgagtactaatagtatgcaatgtccaggttattgcattgagggaaa

SEQ ID NO: 673 - DNA, 1653 bp, Artificial Sequence
  Synthetic Construct
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaa

SEQ ID NO: 674 - DNA, 399 bp, Artificial Sequence
  Synthetic Construct
gtacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggac

SEQ ID NO: 675 - DNA, 936 bp, Artificial Sequence
  Synthetic Construct
atgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagaccttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggacccaggattcttttccaatgctattgttgaaggtgccaagaagtttcctaatactgaatttgtcaaagtaaaaggtcttcatttttcgcaagaagatgcacctgatgaaatgggaaaatatatcaaatcgttcgttgagcgagttctcaaaaatgaacaataa

SEQ ID NO: 676 - DNA, 222 bp, Artificial Sequence
  Synthetic Construct
acgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 677 - DNA, 5258 bp, Artificial Sequence
  Synthetic Construct
gaaggttctcatcatataccgaaagaatgggaaatttgaaaattccatacttttttaaaaagacaatttgttttatcactttagtttttttatatattcagcgtctaccaaatctacacttttttttctttctcgatttagttaatcttcgttcttgtgtcatgtaatagattactatttcaaaacatagatatttagttatctaaataaaactaggccatccatggatggtttcaattttttttttcatatgaaagaaaagttaaatttcatttcacaataaccattgattactaaatttagtaaagaatcaattgggtttagtgtttacttgtttaaggttttttttttttcttttgttatggttctatactaatatcaaagagttatgggccgaagcccatacatctttccgtcgagaatctcatatattctttatcgaagcccatacatctttccgtcgagaatctcatatataccttatcccattcaacattcatacgagcgccgctctagggtttttgcttttcgccattggtccaagtgctatttggttgtttaaggttgcttttagcacacaactttaatattatttttatgtttttcttcttacgatttatcgatttgtgggatactgacaatcagattattgttgttttttccagccaaatatcagatcttgcgccgctctttatcccattcaacattcatacgagcaccgctttacggtttttgcttttcgacattggtcgaagtgctatttggttgtttaaggttgcttttagcacacaactttaatattatttttatgttttcttcttacgatttatcgatttgtaggatactgacaatcagatttttgttgtttttttcagccaaaaatcagatttttttacattttgtttagagaatgattttggttcccgatttgtctgtttttcgcttatgtgtaaagtactttgaaaaatattgtgttaactctacaatgggtatcccaaatttttgagttcttttgtcttgttcgttgtcgagacactagaaatgttaatttaattctcttcttccaaaaagaaccatttactggttcattctctacttgaattttattctggttgtatttcttttccagtataaagcagattgttttttgttatttttcagtttagattggctttgtctcttttgagttgttgcaattgtcaaactttggaatgaaatagtaaataatcttaggttggtagtaaatcttaacattgtgtttttggggcataatttatcgataaaatcttcagcattaaaaccaaaaagaaaaaactttttaagtcttttttgtttggtggttaatataaagtttatacgtgtattaatttgatcacactcactatatgtccagggagctaaacctctatatcgagtactaatagtatgcaatgtccaggttattgcattgagggaaaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaattctagagaattcgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatccactagccttgacaggatatattggcgggtaaactaagtcgctgtatgtgtttgtttgagatctagatcttggcaggatatattgtggtgtaacgttatcgtacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacagcccaccaccatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagaccttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggacccaggattcttttccaatgctattgttgaaggtgccaagaagtttcctaatactgaatttgtcaaagtaaaaggtcttcatttttcgcaagaagatgcacctgatgaaatgggaaaatatatcaaatcgttcgttgagcgagttctcaaaaatgaacaataattctagccggtacgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatcgataacattaacgtttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgag

SEQ ID NO: 678 - protein, 608 aa, Nicotiana tabacum
MDNNLSGEDNDNIDWDTEDELEIQEIQDTTFSSCMDLRTTGQHTVRCDGEASSSSVPCQSKFIQQFVVMGFPEASIAKAIEQNGEDSDLVLDALLTFKALEDSPEEQPSASPQPCINSDDSSSEYNENLLDDVYEEDSWSSDSDSCRNSAKQCYVKVESSSSSEKEQTLLFLASMGYPAEEASIAMERCGPEASVAELTDFICAAQMARAEDVYLPEDVKPKLNHILNGSGGYKKRKMYNELCKRKKAKAIFEEETIRLPKPMIGFGVPTEPLPAMVRRTLPEQAVGPPFFYYENVALAPKGVWDTISRFLYDIEPEFVDSKYFCAAARKRGYIHNLPVENRFPLFPLAPRTIHEALPLSKKWWPSWDPRTKLNCLQTAIGSAQLTNRIRKAVEDFDGEPPMRVQKFVLDQCRKWNLVWVGRNKVAPLEPDEVEMLLGFPKNHTRGGGISRTDRYKSLGNSFQVDTVAYHLSVLKDLFPGGINVLSLFSGIGGGEVALYRLGIPLNTVVSVEKSEVNRDIVRSWWEQTNQRGNLIHFNDVQQLNGDRLEQLIESFGGFDLVIGGSPCNNLAGSNRVSRDGLEGKESSLFYDYVRILDLVKSIMSRHKH

SEQ ID NO: 679 - protein, 354 aa, Artificial Sequence
  Synthetic Construct
ETIRLPKPMIGFGVPTEPLPAMVRRTLPEQAVGPPFFYYENVALAPKGVWDTISRFLYDIEPEFVDSKYFCAAARKRGYIHNLPVENRFPLFPLAPRTIHEALPLSKKWWPSWDPRTKLNCLQTAIGSAQLTNRIRKAVEDFDGEPPMRVQKFVLDQCRKWNLVWVGRNKVAPLEPDEVEMLLGFPKNHTRGGGISRTDRYKSLGNSFQVDTVAYHLSVLKDLFPGGINVLSLFSGIGGGEVALYRLGIPLNTVVSVEKSEVNRDIVRSWWEQTNQRGNLIHFNDVQQLNGDRLEQLIESFGGFDLVIGGSPCNNLAGSNRVSRDGLEGKESSLFYDYVRILDLVKSIMSRHKH

SEQ ID NO: 680 - protein, 386 aa, Artificial Sequence
  Synthetic Construct
MSKVENKTKKLRVFEAFAGIGAQRKALEKVRKDEYEIVGLAEWYVPAIVMYQAIHNNFHTKLEYKSVSREEMIDYLENKTLSWNSKNPVSNGYWKRKKDDELKIIYNAIKLSEKEGNIFDIRDLYKRTLKNIDLLTYSFPCQDLSQQGIQKGMKRGSGTRSGLLWEIERALDSTEKNDLPKYLLMENVGALLHKKNEEELNQWKQKLESLGYQNSIEVLNAADFGSSQARRRVFMISTLNEFVELPKGDKKPKSIKKVLNKIVSEKDILNNLLKYNLTEFKKTKSNINKASLIGYSKFNSEGYVYDPEFTGPTLTASGANSRIKIKDGSNIRKMNSDETFLYIGFDSQDGKRVNEIEFLTENQKIFVCGNSISVEVLEAIIDKIGG

SEQ ID NO: 681 - protein, 1479 aa, Arabidopsis thaliana
MEANEESLKGKIEKLEGKEVIVESKEDEMDIIIEENREAEQEVMEVKARDGRGEQNDVLMEENNNQGEQKDEEMQDASSRSESSDFNSDEDEQILSRRDDELDLEKPLSEEEIDELISDLLAVESKAAEAQEALEKESLSKVESEVREELAQALRGDELDEAVAAEMMTFKDEWEATLDELETESATLLEQLDGAGIELPKLYEMIESQAPNGCYTEAWKQRAHWVGTQVTKETVESLANAERFLHTHRPVRKRHGKLLEEGASGFLEKKLADGAVKESLAGTSELDWSSLNKVFSEKRDESVSFGSKQWASVYLASTPHQAAAMGLEFPGVNEVEEIEEIDASLADPFLADAIDNERELALTEEQKTNYIRVKEEDDITCDRVLQLRLKRKRRKKRSKQVIRCAAENMDDDSVYLDGNNTTPNFAKDQVKSPETSTQVHNSEVNIEENGNFSNSDVDKMTPSTHINVDAKRDDSQNPANNFRCTACNKVAVEVHSHPLLEVIVCMDCKRSIEDRVSKVDDSLERHCEWCGHIADLIDCRTCEKLFCASCIKRNIGEEYMSEAQSSGWDCCCCSPIPLQRLTLELEKAMRDKKSIELSSDSSSDSSSDNNSVDTDADVNVTISSKKKSKKKIRRIIDDAELGKDTRTKIAIEKARQERLRSLQFSARYKTISSMGDVKSIPEGAEVEVLGDAHSGYIVNVVREIGEEAVRVPRSISAKLKVHQVTGIRFMWENIIQSISRVKSGDKGLGCILAHTMGLGKTFQVIAFLYTAMRCVDLGLKTALIVTPVNVLHNWRSEFEKWMPSEVKPLRIFMLGDVSRERRFDLLTKWRKKGGVFLMGYTNFRNLSLGRGVKDLNAARGICNALRDGPDILVCDEAHIIKNTKADTTQALKQVKCQRRIALTGSPLQNNLMEYYCMVDFVREGFLGSSPEFRNRFQNPIENGQHMNSTAEDVKIMNQRSHILYEQLKGFVQRMDMNVVKKDLPPKTVFVISVKLSPLQRILYQRFLELYGFSDGRTDERMRKNFFAAYQVLAQILNHPGIPQLRSEDSKNGRRGSIVDIPDDCSSDENIDYNMVTGEKQRTMNDLQDKVDGYLQKDWWVDLLQKNNYKVSDFSGKMILLLDILSMSADVGDKALVFSQSIPTLDLIELYLSRVPRHGKQGKFWKKGKDWYRIDGKTESSERQKLVDRFNEPDNKRVKCTLISTRAGSLGINLYAANRVIIVDGSWNPTYDLQAIFRAWRYGQKKPVFAYRLMARGTIEEKIYKRQVTKEGLAARVVDRQQVHRTISKEEMLHLFEFDDDDEKSEAVTEISKQNEAGHSNLVEQAILWTKKATLSRVGGDKLMENLLQRHGPNWISSFHEHETLLQENEEERLTKEEKDMAWEVYRRALEWEEVQRVPFSESPVVPKPSPSTQTEPLPQPKGFNRSRFVNRNCTRIAHQLTLISQGLKVGSSTVCGECGRVIRWEDVIPASKLSAVIVN

SEQ ID NO: 682 - protein, 1483 aa, Arabidopsis lyrata
MEVKEKDEVLEKKEDTVEAKEDEMDIIITEERMEAKLDEVKARDERGEQNDVLMEEINNQAEQKDVLMEEDNNQAELKDEEMQDTSSRSESSDFNSDEDEQFLPGRDDELDFEKPLSEEEIEELISDLLGVESKAAEAQEALEKESLSKVESEVREELAQALRGDELDEAVAAEMMTFKDEWEANLDELETESAHLLEQLDGAGIELPKLYEMIESQAPNGCYTEAWKQRAHWVGTQVTKETGESLANAERFLQTHRPVRKRHGKLLEEGASGFLEKKFADGDIKESLAGTSELEWSSLNKVFSEKRDESISFGSKHWASVYLASTPHQAAAMGLEFPGVNEVEEIEEIDASLADPFLADAIDNERELALTEEQKTNYIRVKEEDDINCDRELQLRLKRKRRKKRSKQVIRCAAENMDDDSVYLDGNYIAPNFAKDQVKSPETSTQVHSNEVNKEGNGNLSNSDVDKMVSSPNINVDTMRDDSQNPANSFMCTACNNVAVEVHSHPLLEVIVCMDCKRSIEDRVSKVDDSLERHCEWCGHIADLIDCRTCEKLFCASCIKRNIGEEYLAEAQSSGWDCCCCSPIPLQRLTLELEKAMRDKKSIESSSDSSSDSSSDNNSVDTDADVNVTISSKKKSKKKIRRIIDDAELGKDTRTKIAIEKARQERLRSLQFSARYKTISSMGDVKSIPEGAEVEVLGDAHSGYIVNVVREIGEEAVRVPRSISAKLKVHQVTGIRFMWENIIQSISRVKSGDKGLGCILAHTMGLGKTFQVIAFLYTAMRCVDLGLKTALIVTPVNVLHNWRSEFVKWGPSEVKPLRIFMLEDVSREKRLDLLKKWRNKGGVFLMGYAKFRNLSLGKGVKDLNAAREICNALRDGPDILVCDEAHIIKNTRADTTQALKQVKCQRRIALTGSPLQNNLMEYYCMVDFVREGFLGSSPEFRNRFQNPIENGQHMNSTAEDVKIMNQRSHILYEQLKGFVQRMDMNVVKKDLPPKTVFVISVKLSPLQRKLYKRFLKLYGFSDGRTDERMRKNFFAAYQVLAQILNHPGIPQLRSEDSKNGRRGSIVDIPDDCSSDENIDYNMVTGEKQRTMNDFQDKVDGYLQKDWWVDLLEKNNYKVSDFSGKMILLLDILSMSADVGDKALVFSQSIPTLDLIELYLSRVPRHGKQGKFWKKGKDWYRIDGKTESSERQKLVDRFNEPDNKRVKCTLISTRAGSLGINLYAANRVIIVDGSWNPTYDLQAIFRAWRYGQKKPVFAYRLMARGTIEEKIYKRQVTKEGLAARVVDRQQVHRTISKEEMLHLFEFDDDDEKSDAVTEISKQNEAAQSNLVDNSQKQKATLSRVGCDKLMQNLLQRHGPNWISSFHEHETLLQENEEERLTKEEKDMAWEVYRRALEWEEVQRVPLSESPVVPKPSPSIQTEPLPQPKGFNRSRFVNRNCTRTAHQLTLISQGRKIGSSTVCGECGRILRWEDVIPASKLSAVN

SEQ ID NO: 683 - protein, 1484 aa, Cucumis sativus
MEEKHEDVDDVGSASGDSFIDDSEDDGPSTSGKDDQLHLEEPLTEQEIEDLVAEFLEVESKAAEAQEALEKESLAKVEKEVREELALTLNGDDLETAIANEMAAFVEEWEVVLDELEIESAHLLEQLDGAGIELPSLYKLIESQASNGCFTEAWKKRIHWVGSQVTGDLLASVSDAEKTLQIERPVMRRHGKLLEEGASGYLQKKFSTHEIEGIGTEKLEVDWGSLNKVFSEGSKDSDTLFGSKNWASVYLASTPQQAAEMGLKFPGVDEVEEIDDVDGSSCDPFVAAAIENEKELDLSEEQKKNFRKVKEEDDAIFDRKLQIHLKQKRNQKRCKQVSQKDVSPRDEEQPVSLVDCLNPVSDDKVDKCRMGLSDDENGDVKIKVDIPNGSDASSDIDMERSMEHTASVLPSASSNFVEPLGSKRLNDMEEVITQTKKSRTNGVHNDENSPMKEHSALLNTICNTEQNDYDADSLPSTCPNEKIHCTACDQVVIKVYAHPFLRVIVCADCKSMMDDKKNVKEPDCSECYCGWCGHNADLVSCKSCKTLFCTGCIRRNLGVECLLKAQASGWHCCCCRPSLLQSLTTQLEEALGSEELTGSSSDSDSDNPNADINVTISSKRKRKKKIRRILDDAELGEDTKKKIAIEKERQERLKSLQVQFSSNSKMMSSAGFCGNLSEGASVEVLGDASTGYIVNVVREKGEEAIRIPPSISSKLKTHQISGIRFMWENIIQSIRKVKSGDKGLGCILAHTMGLGKTFQVIAFLYTAMRSADLGLRTALIVTPVNVLHNWRQEFFKWKPSELKPLRIFMLEDVPREKRAVLLAKWRAKGGVFLIGYSAFRNLSLGKHVKDRQMAKEICHILQDGPDILVCDEAHMIKNTKADITQALKQVKCQRRIALTGSPLQNNLMEYYCMVDFVREGFLGSSHEFRNRFQNPIENGQHTNSTLDDVKIMNQRSHILYEQLKGFVQRMDMTVVKKDLPPKTVFVISVKLSPLQRKLYKRFLDVHGFNNGKDSSEQLRKRSFFAGYQALAQIWNHPGILQLTKEDKYYVKREDAIENFLAGDSSSDENIDSNIGTGDKPVNANGNHQDKFVSGFFVKDWSNGLLHANSYKEVDYGGKMVLLLEILTMCSELGDKALVFSQSIPTLDLIEFYLSRLPRRGKRGKFWKKGKDWYRLDGRTESSERQKIVERFNEPLNKRVKCTLISTRAGSLGINLHSANRVIIVDGSWNPTYDLQAIYRAWRYGQTKPVFAYRFLAHGTMEEKIYKRQVTKEGLAARVVDRQQVYRTISREEMLHLFEFGDEENLEASTELDQGNGHTSHQIMTGHQGNVLKQKGPLSHGSCSSDKLMETLLGKHHPRWVANYHEHETLLQENEEEKLSKEEQDMAWEVYRKSLEWEEVQKVSPGDFISEQKLTTSNNAHPAPETIDLAQSRARNRFVSRKCTNLSHLLTLRSQGTKVGCSTVCGECAQEISWEDLNRDAKLGK

SEQ ID NO: 684 - protein, 1505 aa, Vitis vinifera
MDEEHEEVEDVESSSSDSFIDDLDNNESMTSGQDDGLHLEVTLTEEEIEELIAEFLDVESKAAEAQESLEEESLSKLEIEVREELAQTLQGNDLETAVAEEMANFKEEWEAVLDELETESAHLLEQLDGAGIELPSLYKWIESQAPNGCCTEAWKQRVHWIGSQVTGDTTESIIEAEKHLQTDRPVRRRHGKLLEEGASGYLANKLASDGNREAVTENAEVDWCSFNKCFSDHASEDSTLFGSEHWASVYLASTPQQAAVMGLKFPGVDEVEEIDDIDGNSSDPFVADAIANERAVDLSEEQKKKFKKVKEEDDANIDRKLQLHLKRRRYRKRSTQETIQKEDRLAENILDNSVLLNDYSQAVLREKTRGDGVSISNNNDDGACQSSKTEVSESLEMPDTLDKERPASNGNSSVLSGSVLPDSTETKGFKRSHDNGELDVDNKRFRTVIIDSDDETHEVGNVSNSLVNNMTKMEGQSVLQETEGDFVGSGSLPSKHMNGNFHCTACNKVAIEVHCHPLLKVIICGDCKCLIERKMHVKDPDCSECYCGWCGRSNDLVGCKSCKTLFCITCIKRNIGEECLSDVKASGWQCCCCSPSLLQQLTSELEKAIGSSSLTVSSSDSDSDDSDEDINVAISSKRRRKKKIRRILDDAELGEETKRKIAIEKERQERLKSLQVQFSEKSKMMNAASCNGNLSEDTSVEVLGDASKGYIVNVVREKGEEAVRIPPSISAKLKVHQITGIRFMWENIIQSIRKVKSGDKGLGCILAHTMGLGKTFQVIAFLYTAMRSIDLGLRTALIVTPVNVLHNWRQEFIKWRPLELKPLRVFMLEDVSRERRAELLAKWRAKGGVFLIGYSAFRNLSLGKNVKDRHMAREICYALQDGPDILVCDEAHMIKNTRADTTQALKQVKCQRRIALTGSPLQNNLMEYYCMVDFVREGFLGSSHEFRNRFQNPIENGQHMNSTSDDVKIMNQRSHILYEQLKGFVQRMDMSVVKNDLPPKTVFVMAVKLSSLQRKLYKRFLDVHGFTNDKVSSDKIRKRCFFAGYQALAQIWNHPGILQLTKEEKDYARREDGVENFLADDSSSDDNIDYNTVLGEKVRNKNEIQQGKVDSGLYQKGWWNDLLHENNYKEVDYSGKMVLLLDILTMCADVGDKALVFSQSLSTLDLIEYYLSKLSRQGKKGKCWKQGKDWYRLDGRTEGSERQKLVERFNDPLNKRVKCTLISTRAGSLGINLHSANRVIIVDGSWNPTYDLQAIYRAWRYGQTKPVFAYRLMAHGTMEEKIYKRQVTKEGLAARVVDRQQVHRTISKEEMLHLFDFGDDENPDILPERGKEEEHTTNQNMTGQVGNSLKDKLSLSHGSCSSDKLMESLLVRHYPRWIANYHEHETLLQENEEEKLSKEEQDMAWEVYRRTLEWEEVQRVPLDESTFERKPAVSNAAPLVTESISLSETKISRLRNHLVQRKCTNLSHMLTLRSQGTKVGCSTVCGECAQEISWEDLNRDGRAVR

SEQ ID NO: 685 - protein, 1469 aa, Medicago truncatula
MRVASGLAPGMLLGKIESHRNERDPEAVQTRVGLWGQSAIMKAVWDVTNGIRADLSQYDVVRGLTKLMTAGSGLAPSMLLGKIESHRNERDPEAVQTTKSQTANGKQQEQTEIANLNKENEASRKRIILPDMEGIPEDEVVNIESASGGSANDDSDDEGSSPSDIDDKLHLEEPLSEAEIEDLISELLEVESKAAEAQETLEEESLAKVESEVRQELEQTLQGDDLETAVADEMAAFKEEWEAALDDLETESSHLLEQLDGAGIELPSLYKLIEREAPDRCCTEAWKKRNHWVGSQATTEIASSVSDAEKYLQINRPVRRRHGKLLEEGASGFLQKKISPETLEPGKKETEGDWDVFNKIISDESGIDASFGSKTWASVYLASTPQQAALIGLEFPGVNEVEEIDDIDGNSTDPFVAAAIANEKELDLSEEQRRQFKKVKEEDDAIVDRKLQVRLKHRRHRKKSKQRETSTPILSMESHAQKSSSVDQFNPDTKEGTSDEGEILSDNNKAAGLNMEATKIKGFDANFHLDNEKPMGDGNLQDPPKYPLGDDIEQRGTKRLNDGELDADKKKGRADIMNSDDDIPVSSSGSSDSDDSDDSDDSDDSDDSETNVSISTKRRRKKKIRRILDDTELGEETKKKIAIEKERQERLKSLRVQFSASSFDTSSAGCNGSSSEGASIEILGDALAGYIVNVVREKGEEAVRIPPSISAKLKAHQIAGIRFMWENIIQSIRKVKSGDKGLGCILAHTMGLGKTFQVIAFLYTAMRSVDLGLRTALIVTPVNVLHNWRTEFIKWAPSELKRLKVFMLEDVSRDRRAQLLAKWRAKGGVLLIGYAAFRNLSFGKHVKDREMARELCHALQDGPDILVCDEAHIIKNTKADVTHALKQVKCQRRIALTGSPLQNNLMEYYCMVDFVREGFLGSSHEFRNRFQNPIENGQHTNSTQTDVKIMNQRSHILYEQLKGFVQRMDMNVVKKDLPPKTVFVITVKLSPLQRKLYKRFIDVHGFSNVKENQENLRKRSFFAGYQALARIWNHPGILQMAKEDKECVRPEDVVENLLVDDISSDDSDSNVLAGEKLKYTNDLPPRKDGNGFFIKGWWKDILQGKIFKEIDQSGKMVLLIDILTMSSDVGDKVLVFSQSIPTLDLIELYLSKLPRSGKRGKLWKKGRDWYRLDGRTESSERQKLVERFNEPLNKRVKCTLISTRAGSLGINLHAANRVVIVDGSWNPTYDLQAIYRAWRYGQKKPVFAYRLLAHGTMEEKIYKRQVTKEGLAARVVDRQQVHRTISKEEMLHLFEFGEDENPETLAELSEQSNPILAGDSLKHTVPHSNGSSYSDKLMESLLGKHHPRWIANYHLHESLLQENEEEKLSKEEQDMAWEVYRKSLEWEEVQRVPIGESVPDPKPEVSKAEEEQPEVETWQLSTKLRNRFTKRQCTNLAHLLTLRSQRIKIGGYTVCGECARVVRWEDLKK

SEQ ID NO: 686 - protein, 1447 aa, Ricinus communis
MEEKHKQVDDVEIVSSDSFIVDSDDDDDEPSTSGQDNGMHLEASHQNSFSCNFREPLTEQEVEELVAELLEVESKAAEAQEALEKESLSKVESEVREELGQSLHGDDLEAAVEDEMTAFKEEWETVLDELETESAHLLEQLDGAGIELPSLYKWIERQAPNGCQTEAWKSRAHWVGSQVTSEITEAVADAEKYLQSHRPVRRRHGKLLEEGASGFLDKKLSIDGTKDNVAENGDIDWDSLNKLFSSGSCKDVASFGSKHWASVYLANTPQEAAEMGLKFPGVDEVEEIEDIDGCSNDPFIAVAIANEKELILSEEQRKNYIKVKEEDDAIIDRKLQLHLKQRRRRKRSKQVMIMTTSNFLFCESRKSKRPNESGEPTNDAKKIRTVIIDSDDEADGINESVSSANRVVVESTLQENIGESGADGHLSQCVNEEFHCTVCHKICFEVHSHPLLKVIICKDCKCSIEKKMHVKDPECSECYCAWCGRSNDLVSCKSCKTLFCTTCVKRNIGEECLSEAQSSGWQCCCCSPNQLQRLTLELEKAMGSEDLMDTSSDSESENSDADIHVAIRKKNKKKKKIRRILDDAELGEETQRKIAIEKERQERLKSLKVQFTDKSKMMNTASCNGNLPEGASFEVLGDAATGYIVNVVREKGEEAVRIPPSISAKLKAHQVAGIRFMWENIVQSIGKVKSGDRGLGCILAHTMGLGKTFQVIAFLYTAMRSIDLGLRTALIVTPVNVLHNWRQEFMKWRPSETKPLRVFMLEDVSRDRRAELLAKWRAKGGVFLIGYTAFRNLSLGKNVKDRNMAREICYALQDGPDILVCDEAHIIKNTRADTTQALKQVKCQRRIALTGSPLQNNLMEYYCMVDFVREGFLGSSHEFRNRFQNPIENGQHTNSTANDVKIMNQRSHILYEQLKGFVQRMDMSVVKKDLPPKTVFVIAVKLSPLQRKLYKKFLDVHGFTKDIVSSEKIRKSFFAGYQALAQIWNHPGILQLRKDRDYVTREETVDNFIADESSSDENLDCNTIIGEKPRNANDFVQRKSDNGFFQKGWWNDLLQENNYKELDYSGKMVLLLDILTASSHVGDKALVFSQSIPTLDLIELYLSRLSRHGKKGKLWRKGKDWYRLDGRTESSERQRLVEKFNDPENKRVKCTLISTRAGSLGINLHAANRVVIVDGSWNPTYDLQAIFRAWRYGQTKPVFAYRLMAHGTMEEKIYKRQVTKEGLAARVVDRQQVHRTISREEMLHLFDFGDEENSDPLAEVGEEDKQVDDQNMSYKVGSSLKHKAPLSHVSCSSDKLMESLLGKHHPRWIANYHEHETLLQENEEEKLTKEEQDMAWEVYRRSLEWEEVQRVSLDESTFERKPPISNAVPSAPNTNSKGPPVRETSSSNVAPSKGILRCRMVQRKCTNLSHLLTLRSQGTKVGCTTVCGECAQEISWEDLNKDSRTAR

SEQ ID NO: 687 - protein, 1496 aa, Glycine max
  VARIANT 412: Xaa = Any Amino Acid
MLSRFYLKARLEMEGKTEDEVVDIESASSGSFNDDSDDEESLVPEKDDGMHLGEPLTEEEIQDLISELLEVESKAAEAQEALEEESLSKVESEVRQELKQNLQGDDLETAVADEMATFKEEWEAVLDDLETESAHLLEQLDGAGIELPSLYKLIEREAPNVCSTEAWKKRNHWVGSLATAEIAESIADAEKHLQVNRPVRRRHGKLLEEGASGFLQKKLCDETQEPIKTETRGDWDLFNKIVSDGSGIDASFGSKHWVSVYLASTPQQAALMGLKFPGVDEVEEIDDVDGNSTDPFIAAAIANERELDLSDEQRRQFKKVKEEDDAIVDRKLQIRLKHRRQKRKSKQREMSTPILLVENHIQKPSSVDTLSPAMKEGTNNDGKIVSDNGKDTCVLMGADNINVFDASHHLDXEKLTSTGGLSDDIEQRGIKRVKSGELDADNKKCRIVIIDSGNEAEVSENKLDCNTQEVKEDLCNNGGDSLPSECLDEKFWCTVCDKVALEVHPHPFLKVITCGDCNCLLKEKTHKKDMGQDCSEGYCTWCGGSNELVSCKLCKGLFCTKCLKKNLGVELYAGMQDTSWHCCSCHPNLLQKLSLQLEKAVGSADIIVSSSGSDSDSSDDSDDSDDSDAKVNVTISSKRRHKKKIRRILDDAELGEETKRKIAIEKERQERLKSLRGQFSASSFEMSSDGCNGNLSESASVEVLGDALAGYIVNVVREKGEEAVRIPPSISAKLKAHQITGIRFMWENIIQSIRKVKSGDKGLGCILAHTMGLGKTFQVIAFLYTAMRCVDLGLRTALIVTPVNVLHNWRQEFIKWRPSELKPLRVFMLEDVSRDRRPELLAKWRSKGGVFLIGYTAFRNLSFGKHVKDRHMAREICHALQDGPDILVCDEAHMIKNTKADVTQALKQVKCQRRIALTGSPLQNNLMEYYCMVDFVREGFLGSSHEFRNRYQNPIENGQHTNSTLTDVKIMNQRSHILYEQLKGFVQRMDMNVVKKDLPPKTVFVITVKLSPLQRKLYKRFLDVHGFTTQVHPEMLRKRCFFAGYQALARIWNHPGILQLTKEVKDYVKHEDAVENFLVDDSSSDENSDYNVLAGEKMRYANDLLQRKDDNGFFLKGWWNDLLHGKIYKEIDHSGKMVLLMEILTMSSDVGDKVLVFSQSIPTLDLIELYLSRIPRRSKREKFWKKGKDWYRLDGRTESSERQKLVERFNEPLNKRVKCTLISTRAGSLGINLHAANRVVIVDGSWNPTYDLQAIYRSWRYGQKKPVFAYRLLAHGTMEEKIYKRQVTKEGLAARVVDRQQVHRTISKEEMLHLFEFGDDDNPETLVDLSQDNEHQDNPILVGHSLKHTAPHSNGTSYSDKLMESLLSKHHPRWIANYHEHESLLQENEEEKLSKEEQDMAWEVYQKSLEWEEVQRVPLGESIMPEQKPEMPIAMPQNVSESCSILPTKLSRRFTIRKCTNLAHMLTLRSQGTKFGCSTVCGECAQEIRWEDLKKR

SEQ ID NO: 688 - protein, 556 aa, Zea mays
MVDFVREGFLGSTHEFRNRFQNPIENGQHTNSTSDDVKIMNQRSHILFEQLKGFVQRKSMNVVKNDLPPKKVFVITVKLSQLQRKLYKRFLDVHGFSSSGYSEKSHRSFFAKYQTLSQVWNHPGLLQMAKEQRGNLRREDAVENFMMDESSSDDNVENYLPNGEKQKDKADQQSKKSNIIMNEESNWWEELLDENTYMKADYSGKMTLLLDILSKSSELGDKVLVFSQSLTTLDLVEFYLAKLQINGKEGKHWKRGKDWYRLDGSTPSSDRQNLVEMFNDLENTRVKCTLISTRAGSLGINLHAANRVVLLDGSWNPTHDLQAIYRVWRYGQTKPVYAYRLMAHQTMEEKIYKRQVTKEGLAARVVDRQQVSRTISKEEMLHLFEFGEEELMEQNENGSTMIEKPSTSNTIKTSVPVPVDSLMLSLLSEQTRWISGYHEHEALLQENEEEKLTKEEQDLALSEWESLRKAASDPERKSSMSAVPTYPNPVRPLKPASRSRQLQQPKANSNNQKKCTNLTHLLTLRSHGTKAGCTTTCNECGQEISWETLNRDGRSR

SEQ ID NO: 689 - protein, 1483 aa, Sorghum Bicolor
MNKDGILSDDKMAKMESVQPNGQLVDIIIIDSQSDENKIGVDTSTSIGDSSLKEYKEPPCTTMDNNANEETSITDDDTESDSYESSLRESDNEQASASVEGTEVPLTEEEVEELVAEFLEVESKAAQAQESLEKESLDKVEIEVRLELSERLQGDELESAVSTEMEQFQMQWENELDDLEIRSSILLEQLDAAGIELPRLYKSIESQVPNVCETEAWKSRTHWAGSQVPEEANRSIKNADEYLQSRRPVRRKHGRLLEEGASGFLTGKIPVEDDDSVKCHEKSWSSFNELIKSKENAENTFGSSNWASVYLASTPQEAAALGLQFPGVDEVEEISEVGGVFDDIKGVDEVELSEEQRRKYRKVTEEDDAKIMKCLQRRLKGKRTRGWCKENIGLVSSCDEKPLPENGVLGAKSDLPSSKKLKTDENKVSMETLKHTFEDDDNEKRLKTVIIESDDDMQTDNKRALQKDGEGSSTEVEKVVDIIDLDLFPSQSPKLPTKSLPKTFKCTICSEMLNASDVHRHPVLDVVVCGSCRFLVIEKNRLEDPVSGGYCTWCARSELLQSCSSCKLLFCTNCLSKNLGEECLSEAKATGWQCCCCIPSQLELLISECDKALGGVESSDSESSNTELSGPENSATVSKRRMKKSIRRIMDDTELGEETKRRIAMEKARQDHLKSMQEQSATKLRSENIGTPFEAPVKICLQDAGDGHIVNLAREEDEEPVRIPSSMSSKLKPHQVEGIRFMWENVIQSVKKVKSGDKGLGCILAHNMGLGKTFQVITFLYTVMRCAQLGLRTALVVTPVNVLHNWRKEFSKWRPAELKPLRVFMLEDVARVKRPDLLTRWRVKGGVLLIGYSSFRNLSLGKHVKDKNSANEIAYALQCGPDILVCDEAHMIKNRRADITQALKQVRTQRRIALTGSPLQNNLMEYYCMVDFVREGFLGSTHEFRNRFQNPIENGQHMNSTSDDVKIMNQRSHILFEQLKGFVQRKSMNVVKNDLPPKKVFVITVKLSQLQRKLYKRFLDVHGFSSSGYSEKSHSSFFAKYQTLAQVWNHPGLLQMAKEQRGNLRREDTVENFMMDESSSDDNVENYLPNGEKQKDRADQQSKKSNIVNEESNWWEELLDENTYMEADYSGKMTLLLDILSKSSELGDKVLVFSQSLTTLDLVEFYLAKLQINGKEGKHWKRGKDWYRLDGSTPSSERQNLVEMFNDPGNTRVKCTLISTRAGSLGINLHAANRVVLLDGSWNPTHDLQAIYRVWRYGQTKPVYAYRLMAHRTMEEKIYKRQVTKEGLAARVVDRQQVSRTISKEEMLHLFEFGEEELMEQNENGSTIIEKPSTSDTIKTSEPVPVDSLMLSLLSEQTRWISGYHEHEALLQENEEERLTKEEKDMALSEWESLRKAALDSERKSNMSAAPTYPNVVRPLKPASRSRQLQQPKVNSNNQKKCNNLTHLLTLRSHGTKAGCTTTCDECGQEISWETLNRDGRSR

SEQ ID NO: 690 - protein, 1476 aa, Oryza sativa
MDENRKLSDDMSKKMEPIHSNGEAGEDKTIIIEPESDANKLEVETDARHGICEAHKAHEYGTMENDLHEEASTTDDDSENDSYEYLLRESDNEQTSESDAGEGDNEAPLTDEEVETLITEFLDAESKAAQAQESLEKESLEKIESEVRLELSESLQGNELESAVSTEMKQYKKEWESELDDLETHIAVLLEQLDAAGVELPSLYKSIESQVPNVCETEAWKNRAHWAGYQVPEEANKSIRKADEYLQSCRPVRRKHGRLLEEGASGFLAGKIPVGDDGSAQCHEKSWNAFNELTKSKEYAESSFGSSNWASVYLASTPQEAAALGLQFPGVDEVEEIAEVEGAVSDIKGVDEIELSEVQRRKYRKVPEEDDAKMTKRLQRHLKERRTRHLHKENIGLASSSNGCCELPPKKLKTYENGVSVELAKRTREDDVEFDNKRSKTVIIESDDDMQTDSKPDSAPSENADEIIDLDIFPSQSPKLGDKVRPKPFKCTICTEMLNVPEVHRHPVLDVIICGSCRFLVIEKNRLEDPVSGGYCTWCVKSEQLQSCSSCKLLFCRNCLSKNFGEEGLSEARVAGWQCCCCLPSQLEHLISDCDKALGGVESSDPENDFAELSVLESNGPFSKHKMKKRIRRIMDDEELGEETKLKIAMEKARQEHLKSMQEQSASKLKSNNIGISLEAPSEVSEYVGDGHIVNLAREEDEAPVRIPSSISAKLKPHQVSGIRFMWENVIQSVKKVKSGDKGFGCILAHNMGLGKTFQVITFLYTVMRCIQLGLRTALIVTPVNVLHNWKKEFIKWCPAELKPLRVYMLEDVPRANIQYLLKKWRIKGGVLLIGYSSFRNLSLGRSARDKTVANEITNALQCGPDILVCDEAHIIKNRRADTTQALKQVRTQRRIALTGSPLQNNLMEYYCMVDFVREGYLGSSHEFRNRFQNPIENGQHTNSTSDDVKIMNQRSHILYEQLKGFVQRMDMNVVKNDLPEKKVFVVTVKLSQLQRKLYRRFLDVNGFSSSAASEKSFQRSGFFAKYQTLALIWNHPGLLQMAKQKGNLRQEDVESFLMDESSSDDNIENYLPNGEKLRSRNDQLSKKSSDVVNEESNWWENLLDENAYKEADYSGKMVLLLDILSSCSELGDKALVFSQSLSTLDLVEFYLSKLQVNGKEGKYWKQGKDWYRIDGSTPSSERQNLVERFNDPENIRVKCTLISTRAGSLGINLHSANRVILLDGSWNPTHDLQAIYRVWRYGQTKPVYAYRLMAHATMEEKIYKRQVTKEGLAARVVDRQQVSRTISKEEMLHLFEFGDEELLEQSGSTMNGHSKVGTEKPPTPNSSETTEHLPLDRLMVNLLHDHSRWIASYHEHETLLQENEEERLTKEEQDMAWLSYNKLLEVAPRKATHDAERKPSTVPTESSLIQPPKATSRSRQPQQPKITSNNQKKCNNLSHLLTLRSQGTKPGCSTSCKECGQDISWETLNRDGRSR

SEQ ID NO: 691 - protein, 1502 aa, Brachypodium distachyon
MDGNGKLSVDELKNMEAGHSNGQPGVDIIIIEPERDENKVRGETNVGEGPFEDNREHKCEETDNGVHEEASTSTDDDSDSDFYFLRESENGRTSESDAEENGIEVPLPEEEVEELVAEFLDVESKAAKAQESLEKESLEKIEAEVRLELSERLQGDVLELAVSTEMEQFKNEWSTELDDLEIHSAVLLEQLDAAGIELPSLYKSIESQVPNVCETEAWKNRTHWVGSQVPEEANQSIRKADEYLQSCRPVRRKHGKLLEEGAGGFLAGKVPIGDDGSVQCHEKSWSSFNELIKSKECAESSFGSDNWASVYLASTPQEAAALGLQFPGVDEVEEIAEVEGDVDVIKGFDEIELSEEQRRKYKKVREEDDAKTIRRLRRQMKKRTRSCCKENFGLASSSNGFSELPPLSDNGVLGSSSGLLSSEKHKSDKNEVSGEPLKRAREDDFELDHKRPKTVIVESDDDMLINSKPALGNQVSDSSSAEVKKVVDIIDLDLLPSESPNFGDKALPKVFKCTVCTEMLNARDVHRHPVLDVTICGSCRFLVIEKNRLEGPVSGGYCTWCVQCEQLQSCSSCRMLFCTNCLSKNFGEECLSKAKVAGWQCCCCQPRQLEHLISECDKALSGVESSDLESDNTSGNESDGPVSKHKRKKRIRRIIDDTELGEETKRKIAMEKARQEHLKSMHEQSASKLSRSNIVTFSGVLSEVSLQDAGDGHIVNVAREEDEEPVRIPSSVSSKLKPHQVSGIRFMWENVIQSVRTVKSGDKGFGCILAHNMGLGKTFQVITFLYVVMRCVQLGFRTALIVTPVNVLHNWRKEFTKWRPDELKSLHVFMLEDVARVKRLQLLNKWRAKGGVLLIGYSSFRNLSLGRHAREKYTADEISNALQCGPDILVCDEAHMIKNRRADITHALKQVRTQRRIALTGSPLQNNLMEYYCMVDFVREGFLGSSHEFRNRFQNPIENGQHTNSTSDDVKIMNQRSHILYEQLKGFVQRMDMNVVKNDLPPKKVFVITVKLSQLQRKLYRRFLDVHGFSSGGASEKPLQRSGFFAKYQKLAQIWNHPGLLQMAKEQRGIVRREDAVENFLTDESSSDDNPNIENQLPDREKQKSKTDQQSKKSDFVNEESNWWENLLDANTYMEADYSGKMVLLLDILSTCYELGEKVLVFSQNLTTLDLVEFYLSKLQIKGKERKFWKQGKDWYRLDGSTPSSERQNLVERFNEPANTRVKCTLISTRAGSLGINLHAANRVVLLDGSWNPTHDLQAIYRVWRYGQTKPVYAYRLMAYGTMEEKIYKRQVTKEGLAARVVDRQQVSRTISREEMLHLFEFGDEESLDQCCNGSTIIDHTAVGTEKLSTSSSKTTELPVDKLMLNLLSDHSRWIAGYHEHEALLQENEDERLTKEEQDMAWSSFKKAQQLEAVPRRSHDPERKPNVIALPTQTSLVPPKVTSRSRQPQQPKTNSNQKKCTNLTHLLTLRSHGTKAGCTTSCTECGQDISWETLNRDGGRLR

SEQ ID NO: 692 - protein, 1410 aa, Populus trichocarpa
MEPLTDQEVEELVAEFLEVESKAAEAQEALEKESLAKVESDVREELARSLQGDDLEAAVEDEMATFREEWENVLDELETESYHLLEQLDGTGIELPNLYKWIESQAPNSCCTEAWKRRAHWVGTQMTKETTDTVADAEKYLQIHRPVRRKHGKLLEEGASGFLQKKLAMDGSEAIAENREVDWASMKKLFSTSSSEDVASFGSKHWASVYLANTPQEAALMGLKFPGVNEVEEIEDIDGNSTDPFVAEAIANEKELVLSEEQRKNYRKVKEEDDAKIDQKLQLRLKQRRRLKRCKQKDVCENSGDLDMEQLMSESNSVFPESDASEPRRSKRPNESEDLSINNKKIRTVIIDSDNEADILEDKSVHGIKVEDQSTLLENIGDPSAGCNPSQGSSEKFQCTACDKVAVEVHSHPLLKVIVCKDCKFLMEEKMHVKDPDCSECYCGWCGKNNDLVSCRSCRTLFCTACIKRNIGEEYLYKVPVSGWQCCCCSPSLLQRLTSQLEKAMGSGDIMVSSSDSDSDSSDTNDGVTISSKRKKQKKIRRIIDDAELGEETKRKIAIEKERQERLKSLKVKFSDKSKMMNFASCSGNLPEGASVEVIGDATTGYIVNVAREKGEEAVRIPPSLSSKLKAHQVAGIRFLWENIIQSIRKVKSGDNGLGCILAHTMGLGKTFQVIAFLYTAMRGVDLGLRTALIVTPVNVLHNWRKEFMKWTPSEVKPIRVFMLEDVSRERRVELLAKWRAKGGVFLIGYSAFRNLSLGKNVKERNMAREMCSALQDGPDILVCDEAHIIKNTRAETTQALKLVKCQRRIALTGSPLQNNLMEYYCMVDFVREGFLGSSHEFRNRFQNPIENGQHTNSTVDDVKIMNQRSHILYEQLKGFVQRMDMSVVKKDLPPKTVFVVAVKLSPLQRKLYKRFLDVHGFTNGRASNEKTSKSFFAGYQALAQIWNHPGILQLRKGREYVGNVENFLADDCSSDENVDYNTIVEEKSRNPNDFIQGKNDDGFFQKDWWNDLLLENNYKEVDYSGKMVLLLDILVMSSDVGDKTLVFTQSIPTLDLIELYLSRLPRLGKKGKFWRKGKDWYRLDGRTESSERQRLVERFNDPKNKRVKCTLISTRAGSLGINLYAANRVVIVDGSWNPTYDLQAIYRAWRYGQTKPVFAYRLMAHGTMEEKIYKRQVTKEGLAARVVDRQQVYRTISREEMLHLFEFGDDENSDTLIDIGQEYRQADTRNISSQTANSLKQNASRSHGSCASDKVMESLVGKHRQRWIFDYHEHETLLQENEEEKLTKEEQDMAWEVYKRSLEWEEVQRVSLDDSTFERKPPMSNGASSAPDASSIPVPSMARPASEASNGAPSQSILRSRMVQRKCTNLSHLLTLRSQGTKAGCTTICGECAQEISWEDLKREGKAAR

SEQ ID NO: 693 - protein, 1480 aa, Brassica napus
MEGKEEEMDRSEDIMDVEIEKEQNDEVMEENNNQDEEMQDTDLRSESSVSNSDEEEGLRSGNDDELDLEKPLSEEEVDELISDLLGVESKAAEAQESLEKESLSKVESEVREELAQTLHGDELDKAVEAEMMTFKDEWEATLDELETESANLLEQLDGAGIELPKLYEMIESQAPNGCYTEAWKKRAHWVGTQVTKETGESLAKAESFLLTHRPVRKRHGKLLEEGASGFLEKKFADDAVKECLTGTSELDWSSLNKVFSEKRDEAISFGSKHWASVYLASTPQQAAAMGLEFPGVNEVEEIEEIDESLADPFFADAIENERELALTGEQKKNYIRVKEEDDINIDRELQLRLKRKRRKKRSKQVIRHTAEDRDDDSAYLYGNSIAPDPAEDQVKCPENSIEFQNNEVNKQENGNLSNSDADKMVPVADLNVDTMRDDSQNPASNFRCTACNNVTVEVHSHPLLDVIVCMDCKRLIEDRVAKQLDASLERHCEWCGHVADLINCRSCEKLFCASCIKRNIGDEYLSEAQSSGWDCCCCAPIPLRRLTLELEKAMGDKKSMESSSDSSSDSSSDSSSDDNSVDTDADVTVAVSSKKKLKKKIRRIIDDAELGKDTRSKIAIEKKRQERLRSLQFSARYKTISSMGDVKIPEGAEAEVLGDAHSGYIVNVAREIGEEAVRVPRSISAKLKPHQVTGIRFMWENIIQSINSVKSGDKGLGCILAHTMGLGKTFQVIAFLYTAMRCVDLGLKSALIVTPVNVLHNWRSEFTKWMPSEVKPLRIFMLEDVSRERRLDLLRKWRNKGGVFLMGYAAFRNLSLGRGVKDINAAKEFCSALRDGPDILVCDEAHIIKNTRADTTQALKQVKCQRRIALTGSPLQNNLMEYYCMVDFVREGFLGSSPEFRNRFQNPIENGQHMNSTAEDVKIMNQRSHILYEELKGFVQRMDMNVVKKDLPPKTVFVISVKLSPLQRKLYKRFLKLYGFNDGRADERMRKNFFAAYQVLAQILNHPGIPQLRSEDKRQGRRGSIVDIPDDCSSDENLDCNMVVGEKQRNMSDLQDKVDGYLQKDWWVDLLQKNNYKVSEYSGKMILLLDILSMCAHVGDKALVFSQSIPTLDLIELYLSRVPRHGKHGKCWKKGKDWYRIDGKTESSERQKLVDRFNEPENKRVKCTLISTRAGSLGINLYAANRVIIVDGSWNPTYDLQAIFRAWRYGQKKPVFAYRLMARGTIEEKIYKRQVNKEGLAARVVDRQQVHRTISKEEMLHLFEFDDDDEKSDAVTEISKRKEAATSSRGCDSDKLMENLLQRHSPDWISSFHEHETLLQENEDERLTKEEKDMAWEVYRKALQWEEVQRAPVSEAPVLQKPSPSPQIQPLRHPRGFNRSRFVNRSCTRIAHQLTLVSQGRKVGSSTICGECGCVIRWEDVLPAPKLSESNHIIARGPRLIPNLAKISDDHVIGNSIWNRTRHYQDSQDSHCFIHLIDSG

SEQ ID NO: 694 - protein, 2001 aa, Arabidopsis thaliana
MKKDEKIGLTGRTIYTRSLAASIPASVEQETPGLRRSSRGTPSTKVITPASATRKSERLAPSPASVSKKSGGIVKNSTPSSLRRSNRGKTEVSLQSSKGSDNSIRKGDTSPDIEQRKDSVEESTDKIKPIMSARSYRALFRGKLKESEALVDASPNEEELVVVGCSRRIPAGNDDVQGKTDCPPPADAGSKRLPVDETSLDKGTDFPLKSVTETEKIVLDASPIVETGDDSVIGSPSENLETQKLQDGKTDCSPPANAESKTLPVGETSLEKEYPQKFQDDNTDCLPPANAESKRLPVGETSLEKDTDFPLKSTTETGKMVLYASPIVETRDDSVICSPSTNLETQKLLVSKTGLETDIVLPLKRKRDTAEIELDACATVANGDDHVMSSDGVIPSPSGCKNDNRPEMCNTCKKRQKVNGDCQNRSVCSCIVQPVEESDNVTQDMKETGPVTSREYEENGQIQHGKSSDPKFYSSVYPEYWVPVQLSDVQLEQYCQTLFSKSLSLSSLSKIDLGALEETLNSVRKTCDHPYVMDASLKQLLTKNLELHEILDVEIKASGKLHLLDKMLTHIKKNGLKAVVFYQATQTPEGLLLGNILEDFVGQRFGPKSYEHGIYSSKKNSAINNFNKESQCCVLLLETRACSQTIKLLRADAFILFGSSLNPSHDVKHVEKIKIESCSERTKIFRLYSVCTVEEKALILARQNKRQNKAVENLNRSLTHALLMWGASYLFDKLDHFHSSETPDSGVSFEQSIMDGVIHEFSSILSSKGGEENEVKLCLLLEAKHAQGTYSSDSTLFGEDHIKLSDEESPNIFWSKLLGGKNPMWKYPSDTPQRNRKRVQYFEGSEASPKTGDGGNAKKRKKASDDVTDPRVTDPPVDDDERKASGKDHMGALESPKVITLQSSCKSSGTDGTLDGNDAFGLYSMGSHISGIPEDMLASQDWGKIPDESQRRLHTVLKPKMAKLCQVLHLSDACTSMVGNFLEYVIENHRIYEEPATTFQAFQIALSWIAALLVKQILSHKESLVRANSELAFKCSRVEVDYIYSILSCMKSLFLEHTQGLQFDCFGTNSKQSVVSTKLVNESLSGATVRDEKINTKSMRNSSEDEECMTEKRCSHYSTATRDIEKTISGIKKKYKKQVQKLVQEHEEKKMELLNMYADKKQKLETSKSVEAAVIRITCSRTSTQVGDLKLLDHNYERKFDEIKSEKNECLKSLEQMHDVAKKKLAEDEACWINRIKSWAAKLKVCVPIQSGNNKHFSGSSNISQNAPDVQICNNANVEATYADTNCMASKVNQVPEAENTLGTMSGGSTQQVHEMVDVRNDETMDVSALSREQLTKSQSNEHASITVPEILIPADCQEEFAALNVHLSEDQNCDRITSAASDEDVSSRVPEVSQSLENLSASPEFSLNREEALVTTENRRTSHVGFDTDNILDQQNREDCSLDQEIPDELAMPVQHLASVVETRGAAESDQYGQDICPMPSSLAGKQPDPAANTESENLEEAIEPQSAGSETVETTDFAASHQGDQVTCPLLSSPTGNQPAPEANIEGQNINTSAEPHVAGPDAVESGDYAVIDQETMGAQDACSLPSGSVGTQSDLGANIEGQNVTTVAQLPTDGSDAVVTGGSPVSDQCAQDASPMPLSSPGNHPDTAVNIEGLDNTSVAEPHISGSDACEMEISEPGPQVERSTFANLFHEGGVEHSAGVTALVPSLLNNGTEQIAVQPVPQIPFPVFNDPFLHELEKLRRESENSKKTFEEKKSILKAELERKMAEVQAEFRRKFHEVEAEHNTRTTKIEKDKNLVIMNKLLANAFLSKCTDKKVSPSGAPRGKIQQLAQRAAQVSALRNYIAPQQLQASSFPAPALVSAPLQLQQSSFPAPGPAPLQPQASSFPSSVSRPSALLLNFAVCPMPQPRQPLISNIAPTPSVTPATNPGLRSPAPHLNSYRPSSSTPVATATPTSSVPPQALTYSAVSIQQQQEQQPQQSLSSGLQSNNEVVCLSDDE

SEQ ID NO: 695 - protein, 2034 aa, Arabidopsis lyrata
MKKDEKNSSAGRTICTRSLAASIPASAEHETPGLRRSSRGAPSTNLITPASATRKSERLAPSPASVAIKSGGMEKNYTPSPLRRSNRGKNVVSLQNSKGSDNSGRNADTSSYIEQRKDKRKNSVEESTNKINKQGPIMSARSFRALFRGKLKESEALVDVSPNEEELVVVGCSRRIPAGNDDAQGKTDCPPPANAGSKRLPVGETSLEKGTDFPLKSITDTENMVLDASPIVETGDGSVIGSPSENLETQKPQDGNTDCPPPANTESKRLVIGSPSEKLETQKLQDGNTDFGETSLEKKYPQKFQDGNTDCLPPANAESKKLPVGQTSLDKDTDFPLKSITETEKMVLYASPIVETRDDSVIASPSENLETQKPFVSKTGLETDIGLPLKRKRDTAGIELDACATVANGDDHVMSSDGVNPSPFGCKNDNQPEMCNTCKKRQKVNGDFQNLSVCSCIAQPVEESDHLTQDMKETGPATSREYEENGQMQHGKSSEPKLYSSMYPEYWVPVQLSDVQLEQYCRTLFSKSLSLSSLSKIDLGALEETLNSVRKTCDHPYVMDASLKQLLTKNLELHKILDVEVKASGKLQLLDEMLTHIKKNGLKAVVFYQAAQTPEGLLLGNILEDFVGHRFGPKSYEHGIYSSKKNAINNFNKESQCCVLLLETRACSQTIKLLRAEVFILFGSSLNPSHDVKHLEKIKIESCSERTKIFRLYSVCTVEEKALILARQNKRHHKAVENLSRSLTHALLMWGASYLFDRLDHFHSSETPHSGASFEQSIMDGVIHEFSSILSSKGEEENEVKLCLLLEAKHAQGTYSSDSTLFGEDHIKLLAEDSHSPNIFWTKLLGGKNPMWKYPSDTPQRNRKRVQYFEGSEESPKIGDGGNAKKRKKASDDVTDPPVDDDERKASGKDHIGALESPKVIALQSSCKSTSGADGTLDGNDTYGLYSMGGHISGIPEGMLAGHDWRKIPGESQRRLHAVLKLKMAKLCQVLHLSDACTSMVENFLEYVIENHQIYEEPATTLQAFQLALSWIAALLVKQNLSHKESLVRAKSELAFDCSRVEVDYIYSILSCMKSLFLERTQGLQFDCFGTNSKQSMVSTQLVNESLSGATVREEKNNTKSMRNSSEDEECITERRCSHYSTATEDVEKTISDIEKKWKKQVQKLVQEHEEKKLELLNMYADKKQKLETRKNVEAAVIRITCSRTSTQVDDLKLLDDKFERMFDEIKSEKNECLKSLEQMHEAAKKKLAEDKACWINRLKSWAQANLKVCVPMQSRNNKHLSGLCSSNISQNAPDVQICNDMNVEGTYADTNLPEAENTLATMSGGSTQQVHEMEAVRNDKKMDVSDLSHGQPTKIMVTKSQSNELASITVPEILVPAGCQEEFAALNVHLSENQNCDGITSAGPDEDVSSRVPEVSQPLENLAKSASPESSLNREEALVTTENNRTSHVVSDTDNIFDQQNREACSLDQDISDELALPMPHPASVVETRSATESDQDGQDISPMPSSLAGKQPDPAANTQGQNLEAAIELQSTGSETVETTDFAASHQGDQVTCPLPSSPAGNQPAPEANIGSQNINTSAEPHVAGSEVVESGDYAVSDQETMGAQDACSLPSASFGTQSDLGANNEGQNITTVAQLPTDGSDAVETGGSPVSDQCAQDASPMPLSSPGNHPDTAVNIEGLNNTTIAEPHISGSDACEMEIAEPGPRVERSNFASLVHEGGVEHSAGVTALVPSLLNNGTEQSAVQPVPQIPFPVFNDPFLHELEKLRRESENSKKTFEEKKSILKAELERKMAEVQAEFQRKFNEVEAEHNTRTTKIETDKNLVIMNKLLANAFLSKCTDKKVSPSAAPRGRIQQLAQRATQVSALRNYSASAPQQLQASSFPAPALVPAPLQLQQSSFPAPGPAPLQPQASSFASSVSRPSALPLNSAICPMPQPRQPLISNIAPTPSVSPAANPVPSASLRSPAPHLNSYRQSSSTSVATATPTSSAPPQALTYSAVSIQKQQQEKQPQQSLRSGGLQMNNDVVCLSDDE

SEQ ID NO: 696 - protein, 2801 aa, Cucumis sativus
MVKDTRSSVRERNEENNNLKGKQNGEKAPARAGSTTPDSSALRRSAREASLKKIIIVTPSKSRKSDRLDKHSPRTRSDKKKHGTIVQKDMLNPLRRSERVKKQSSSTSSGSGSKKLVKSSSTSSGSVSKKSDKSSGSPYTKEKKEKKEKSIEQLILDPREAGKSPKQDEVSQNAKDKRMDARAYRALFREKLKTGNVDCREQAKMPKSNDHCGSNSCKEDLNQSSKYSEKSKELRSSCLEKSSTRDLDDSNEIDTKELRSKCLEESSTVYLDDHPETRSKTSEEVLKNDSELDFFLSSQKSSEEEVLTKLSNEDSGTVHAVNDADKKLEALERSNSMLEEKIVDDFIDSNGGCKLISLKRKRSMLHLDSNVSVRNGSESTCSSPTEAVQLLSSPCRQSDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVGTCGDQVETCGKCLKRQRLGNDSLKDFCSCVEIDQQQNETISIDVDRGKSMGNSISDPTGNCVWCKLEKASLDIDPNACLICKVGGKLLCCEGKECRRSFHLSCLDPPLEDVPLGVWHCPMCIRRKIKFGVYAVSKGFESIWDTRETEISDADGSQRQKQYFVKFKDLAHAHNRWLPESKLLLEASSLVSRFIKKNQYSRWKEEWAIPQRLLQKRLLLSAKLCEEHDAEFSGAELNCRYEWLVKWRGLDYKFATWELGNASFLSSLDGQGLMKNYESRCERAKLASHVSEVDEKHELQILHRKRTAVANLSQFTDKDTCGFNDNYISYVNKLYQFWHEGKNAVVIDNQDRMAKIIAFILTLQPDVLRPFLVITTSTALGLWDSELLRFAPSFNAVVYKGNKNVRKNIRDLEFYQGSYPMFQALICSLEVMMEDLDILQRISWEVIIVDECQRPIICSHLEKIKMLDGNMWLLVLSDQLKDIKDDYHNLLSVLDVNDQVENKDTLKTNGDDNISKLKERLSYHIAYISTSRFVEYWVPARISNVQLELYCAALLSNSGLLCSSFKSDLLDNIHDLLISTRKCCNHPYIVDSSMGHVITKGHPEVEYLGIGIKASGKLQLLDAMLKEMKKKGSRVLILFQSISGSGRDTIGDILDDFLRQRFGPDSYERIDGGLIYSKKQAALNKFNNLESGRFLFLLEVRACLPSIKLSSIDSIVIYDSDWTPMNDLRALQRITLDSHLDQIKIFRLYTSCTVEEKVLMLSLENKTLDGNLQNISWSCANMLLMWGASDLLADLEKFHGKEKTEDALSDSTLLEEVVNDLILLISQNGRSTDKYDSHVILEVQQIEGVYSACSQLPGQLKKLSTEEMQPFIFWSQLLCGKHPKWKYSSDRSLRNRKRVQQTDDSLNKSEYEIEESVSKRKKVSNNNVKVAQEENFTHKEKEGTSKAPKHTCQNSTSLAACEDDSYIENHLSTSSLIANDILKILKYKSVGFDEIRKLTDLRKSLHCLLKPEISQLCKILKLPEHVKDEAEKFFEYVMDSHHILTEPATTTLLQAFQLSLCWSAASMLDHKIDYKESLALAKEHLNFDCHRQEVYLLYSRLRCLKKIFYKHLKCSKGTESPYNVLSDDEFQRAVVKSINRIQKTCRKKFKKLKQKQQEKRDEFDKTCDEEKSQLDRQFRMESVVIRSCLHNSLLMRNNKLQVLENRYAKKLEEHRYQMEIRCRKLEEEQIDERNKMVATEAHWVDTLTSWLQVELLNKQILNKTKHFHYLKNDTTICDHLPEEIYSKIAHSVSGTRKEIFEIPGSVFSEDIICSNTVEEGSLQTRHNGETAALDTMGSQGPSASEFVDDNGINISNGIEGNVTSENSCSVEKLPERVILGNPDKEISMKGPKSRCSVSVHMVSHVDEEVPHKLTEAAGLIESSTRVLTIPLLPSMERGGNVATLNPGIEISNATCRIGNSEPFVDAHSNLESSPRELNLPVNEVERLSEVANLVGVRKNLSASQSSSRESIPNKSMGSTSEIEFSSTMTVSASCEALEVGCSNSQNDGDNHRELVNPCVVEDTIGNTDPNVHSHEPSVTLSPLDLAVTPTTQGNVSLLFNEAAHEEMNQQSSSTRSIDYIMEAVEMAIVNGDPEAPISYVADQSNQEECENLQSSCTGSMENNMQATEMVNANEDTEAPITHVADQSNQEEQDEINLQSSCIGSMNDIRQTTAMVNTNGDNETPNPYVASQSNQEAQIVEPQTLTVPLATNSSVGFFQADLSSAGGMENQINCEDYSSDQLAQTASQPIEDSIELIEEALLQPVTCTAPHSIFNAGISDTRTSFTDTRSISGNFDISTGLMQPTQPSVSQMLPLSYVDPLEKELEKLRKEMEHNKDVHAKQKLQLKSEREKEIEEVNKKYDTKVQESEIEFDLRKKDLDVNYNKVLMNKILAEAFRWKYSDTKSWDIVPVLGPQIFQPTVMPILQRPPLVVRPSFTPSLVSSHTSNAPSVNIQRTSAVANLSTNSPVSSQGTTSTSIHGHHASPHFSSNSMRPLHIGSISSPTGNPQVSSVIRAPAPHLQPFRPKSSSLPPNPRGITSQHGPTIPSATPPSFPHHPPRPPVSSPFQSIPLNRPYRPNSLEQLPTLSSAPLSALDLLMDMNNRAGVNFPHNFPLPDASLNTHQPNPPVSTGNMQVNAVNTTGDSNVVCLSDDD

SEQ ID NO: 697 - protein, 2058 aa, Vitis vinifera
MTALLIRCCDGKGCKRSYHLACLDPPLGEIPPGIWHCMLCVKKKTELGVHAVSEGVESIWDTREVELPSAEGVQKQKQYFVKYKGLAHVHNHWIPESQLLLEAPSLVAKFNRKNQVIRYKLEWTVPHRLLQKRLLMPTKQSDGYYTGRAGDIPDCLYEWLVKWRGLGYEHATWELENASFLNSPEAQSLIREYENRRRKAKSASDPSITDKGRKASLVKLSKLPGAGSIGIDDNHLSCVNKLRENWHKGLNAIVIDDHDRVMRVVLFILSLQADVCRPFLIISTSSVLPLWEAEFSRLASSVNVVVYSGNKDIRRSIRTMEFYEEGGCIMFEVLLAPPEVVVEDLEVLECLGWEAVIIDECQRPRISSHFAEYRMLVADLRLLLFSGQIKESTLEFVNLLSFLDSGNDVNSSNVLKTDYNDSVSILKERLSQFIAYDCKSDSSRFVEYWVPIPLSNVQLEQYCGTLLSNTISLCSCSKNDPVGALRDVLISTRKCCDHPYIVDLSLQSFLTKGLPEIEYLDVGINASGKLQLLDRMISEIKNRGLRVLILFQSIGGSGRDSIGDILDDFLRQRFGQDSYERVDGGGVPSRKQAALNKFNNKESGRFVFLLEIRACLSSIKLSSVDTIIIFDSDWNPVNDLRALNKITIDSQFEKIKLFRLYSPFTVEEKSLILAKHDMALDSNLQNISRSTSHMLLMWGASYLFNKLEKFHGSDAPDSRTDTSSEQSLLKGVMQELLILLPHNGANIDLSNSSIIIKVKQNEISYCKNVTLHGELEIQSTDKVPPHVFWTKLLEGRYPQWKYSSGPSQRNRKRVQYFDESSKRSEHESDEVVKKRRKVDKGKLVTGDKEGASGISANNESQSLSRPTACTHDALHANRASTSPPLVSDISEASSEIHTIEFEGRRKLRDAQKSLHLVLETDISKLCDILQLSEDVKGMVGRLLEYVMNNHHVNREPASILQAFQISLCWTAASLMNHEIDRKGSLMLAKQHLAFTCKEEEVEYVYSKLHSLKEKFQYRSENLRVADFEQDLMSVSKGYLKNLLHGRESWELNHTKVKVEAEEIPLAQECSDKQVSSQQGQAEIATVENEISKSIKRIQKKCNKKMKKLLWKQQEEMKELDKIDEQEKAQLENDHKVESALIRSMYGLPLRTDKLEMLDKDYAKKIEEHKRQMSVQIKNLEAMHLAARNKEKQDAARWLQAVESWAQDELLRKLPLNDSACRAEDSQSGELGRCHAPTSFASGPAAFSKEQRQGMTQDEMGQSGVHETVPSNSVSSSHPIEILTLPVNPSSKDDRLATMASEKASVTGFEQHNRSGSSSNGPENIVSAHPLSSEDHIPDGAISSFPDRGIQSEVPDTCPDEVEVGDSNRENDEADTIASNRTNSIGGGDLHDEVSISTIGESLSQELPLVNSLPVQPLTSTEGAELPLNQALQAECFQPSSSSGMPDEVTTIGGEQDTLQQVEVTLLHPINDVLSEHTNCEGSRTPHNVSSASGIDHQPCTEGHSSFQNAQVPTEPVGIPVELSSNQAISQPIPQLAVECQLSSERHTSFHDVQAPARLVENPVELSNQAISQPSMNLEIEHQPSGEGHASFQNVQVAPLLGENPVELSNQAALQTGAHLATEQSSSELGSSIQNSQTPTQLVEDSVENTCREGGSSFQNAQTPTQLVESSVELLNQAVSQSVTHLAVHQPIDTLAGGSDTRTTPIISGLSNRPIQTAPPVPLRMPLPLHSDPLQNELERIRKEIDQTIKIHEDTKQQLKSDCEKEIEEVVAQLRGKYDAKLQDVEATFVLKKMELDINQKKVTMNKILADAFRSKCMDVKASGAPGVQQDAPRPSFTQQIYQLSLQQGSQRPSIASSSSFLGTPAAVPQTTVPPPVQVVHHSSALFSSVPTRPLHISPITPPTGNHQVGSDIRAPAPHLQPFRPAIPMSSTSLPSLMRGMPSQPAPSNPPSTSSTLPQLSQLPARLPLTSYQSCQQNSGQRLENPGGSLALNNPPISALELLMDVDNRIGPNPWNVLAPPSDTSSNLELLDTSEPRALDGTRAHAGLTSDVVCLSDDD

SEQ ID NO: 698 - protein, 2096 aa, Medicago truncatula
MVKSTRSSQKAKDEENNNGRVTRSSEKAKIKAHPNVSDTAGIRKSSREKPSKIIATSSSTQKSEQVEKGTLPAPETRRKSVRVEKMKTPSPLTRSGKTRNHSFSGPSDSKSAGSLGSISRQKLQKEKSVKHLTFEAKEVNENEEHNRESSQVKRKKMTALMYRSLFTQPKKDCLGNSDNNSKSNQEGDNSSGAKIDELSKGSCSDNKEVSKNGTLPSEDARAKETTVDSRIGDKSKGDNSSGAKIDELSKGSCSDNEEVSKNGTLPFKDGKAKETRVDSRTDEPRCQSKGDNSSGAKIDELSKGSCSDNEEVSKNGTLPFEDGKAKETRVDSRTDEPRCQSKADNSIGAKIDELSKGSCSDNKEVSKNGTLTSEDAKAKETRVNSRLSGPMTDLAENCATPGSFIPSNTPTYETSVVPRRVQPDCCGEETLPTLVSGDSVFDDDDLVNNNAGLGGGEKLAPSKRKAITMDIDSNVPSSLSKGDSSNLIPDALPSKLGGNESCSKRIRLDFNPTVEESRDPCATEDIDVIEATMQQKDKSDHASGTGHLKGTTVEDKNIHALLDSQSVVHPKEKVSSHIANRCKSDSYKLVEYWVPVQISNVQLEQYCNTLLSNASFLCSSPKIDSVGAIRDVLISIRKCCNHPYIIEESLQPLLLKGIEEVEYPSQKEKAVAYLNVGIKASSKLQLLDSMLTELRKNKLRALILFQPIGVSGKTSIVDILDDFLRQRFGEDSYERIDNCLTASKKQAATKIFNDKNNKRFFFLMETSACHPSIKLSSIDAIIIFDSDWNPMNDIRSLQKLTLDSQFESIKTFRLYSPFTVEEKALILSRQGKTLDINCPSSSRGLSHTLLMWGAVHLFDELRVFHDGATSTSNLKPLLEETVSQFSSCLADVGEDSDTSNCSILLKVQQHGGAYLANSPLFGELEFRSPDEESPQKFWNNLLVGRQFQWKYSCGSTQRSRRRVQPFNNLAGGTDLVNEGTTKKRLKVSNNNVDQPSSKSVGEKLPNGIKAGTFVDLVDKPQGNDDVESGKNGRVHDELRSLHLSLKPQITELCEVLLLPDNVRNVVDNFLEYVTNKHHFNWESVSIQSFQISLIRAAASLLNHKVDQKTILALSKEQLNFDCKQAEVDYSYSFLQCLKKIFVYRTGTYNDNSSPKVCKSLNGVSCTEVVQEVELFKKDLSKSIKKIQKKFVKMLNKVRLMYQEEKHRLRVVNEDEKAELERKYKIQLAMTRSCYPNEVVRTETLNILNVDHQKSIEELKCEHETRLKELEDEHSEHIRKYQVWEASWVEEVKSWAKNELLNIVASKGPGTGIDYLQMCDNVVESMIEAGAMVTETNSPSVGKTVKLQNSLVKHDRANEMDILVPNDQPISGSEDHNMTENQYSQENIISKHSHSREQNSDGATSMTDETNRSENFGHESQDGCERSNLGITSLPDYENATHTEHQCSDGVSSGVEGQIPVELQETTDKGDSVSISERQVQVEMPVTDNSTDCQLENANQLNPPSSMDQTSDKVSIDVPVVDGVLSSKPCQAVGLTGCQDKISLSNPPLEQQIPDGDVPVMEPENSHAVAECHMEPSINAMLVDNSTTDDQEGGVQGNVTSAPVPRPVNVMEPLGQGKELPSVKSAADKNSDGAMQNSSEQVQVASSSADVVPANQITVPSKQVHQLAAAEPSSNLALSGFSTVHLATEDEHQLNSVHSLPTHHSEPTSVVPNKDAGQSHSNSALGLHSNQVAVHPISNSDLDLLTASRVRAQCGYRRNLSNPLEMNNHPIQSTPPSSSRRLQHLSYDPLNIEFERIQKVIEQSSKNHEDTKLRLKSDFEKELAELRRKYDVKFQEIEVEFQQTKKTLDTNLNTVYVNKILANAFKSKCLDLKVSGASGVQHDSLPQHLHQLSRQQAATRPFLVSGSSSGESPVTSLPSPSIAPNSQHMLPPGYNMSGTFSSASARPPLINTTRSSIARDIQGGEIRAPAPHLHSSRPSISAPPSSFNPLQRGIPSQTAASNLRATSPSYAHVSPWQRPPSYQSNPQMGRRPDSAGRSALLGNFSSQSTKTPPNIISRLSDVAPANLSRSGPNSSSVVANSSHQAASQNLVCLSDDE

SEQ ID NO: 699 - protein, 1982 aa, Ricinus communis
MNSKAVGGKPSTISARETPTNRSMSSNPSGTRKSERLEKRTPTPLVKGKDKKQSTQSPLRRSERGKKQFSSSSSGSKKSNKNIGISVMKKKVKKEKSVKQLTFETEEVSRSKTQVEKKRLNARDYRALFNLQRKKVSVAGCGKELNLENKLSQECSSSDEGGASKNVGRGNECGRGKVEELRKIHTGRGSERTKEESNCSLSKPADEIVENNIGLDSSLSSQNHKFVEGAHLSEDGTSLENSKGGDCVLLSSHKTVSGKQDDCDEMAKKIVQSELVTPASSGGLPDSGGGLDIGSKDIPPKRKRNTDNIDSDSTALASSKDVCPPLANAIISSPHGSNFAESCATSFKKQSQNWPKPKSICKCKVNKLKSKLNDMNGFASLSTKSSHKMGNLKERLSKYIVNGSKSDSLKFVEYWVPVQISNIQLEQYCATLFSNSLFLCSSSKNDLVGALSDILVSIRKCCDHPYLMDPSPEDILTKDAKVVDILDIGIKASGKLQLLQAMLIEIRNRGSRVIVLFQVYALHRNSWKDKIGDILDDFVRQRFGQDSYERIDGCVNQKRKQAALNNFNNQKTRFVFLLESCACLPSIKLSSVDTVIIFGSDWIPANDLRNLRKITLDSQFEQLKVFRLYSSFTVEENVLILAKHDKILDSNVQSISRATTQSLLMRGASYLFRKLDEFQNSSILNTNRSSSFDESSEKDVIRDFLTILSQDAKDNNSSTFSVIVKAKLNQGTYVSDPPLPGERKSQVRDEEFPHRFWKKLLEGKQPEWTFTSGLSQRNRKRVQNSEDILKKPEGEHGEVVKKHKKAANNDVGQNHFESAPFEGNTDTGNNEGNLGGPSHNVHQLMSGSSDHLNASYANHAPSLQSLTNVILDEPSSNMAKSNERINVHDSQKSLHLLLKPDMAKLCEILKLPDNVKAMVQSFLEYVMNNHHVIREPATILQAFQISLCWTAASLLKHKIDHKESLALAKQHLNFGCKKEEADYVYSKFRCLKKVFLYHTGNVMLTCSSENSQSVTRVVNKEYLQARSGQELLQLGLAKQDFSKSIKDIERKCDKQMRKVSQKQQEEIVEFNKKYNEEKAQLEYKQKTEAAVIRLHSNSSMRKNKLKLLDIEYKKKFEELEQQMVIRRKDLEEMHMAARDKLKKRKACWLEGVKSWAQVELINKPPSNKIGHNQENAASVNSYLKKQNPEVIQGMQNKKVPLEVPETVSSDDDDDYLLPGVQSTNEQIFDGVRSDLPDGEAPLRISTAISLRDGLEVNVPSSREQFSNAEVPLGVSEAVSSSDGAEHTNKFTCNEHNNGPTVMRPQNLSMGGSEIANSVGSQENIQGLESSPEAVIGERDGVQALNLENATEVDEEDVVCIANKDPNSRMIAGYQHNEKVSSGAIESASNKAASDNSCKQQNEKALMERTISNDSSDKTAGLGQQDTGAASGVPETALIEEIQGGETSKEQDGMIEAIETVNNEDSQSLGKTAGLGQQDTELLSGVIETAPSDVGDGVECLLPTGSTRLQDGVASVSMNPDNLQQVDASVQRQNDIAASPENVDAHVAEHVLQMPPTESAISVNAMDLPSTSETQHQSNHEDFITCNIAGTSMPMVEDQVQCSDLAISQHGTHTTQHLPADIPVHGSGTHVSDTRTLPISSGVNNYTVQTVPPVRVPPLPFYHDPLQVELERLRKEADQIVNAHENTKLQLKSDCEQEVAQIRKKYEVKLQELESEFLMKKKEMDMNEKKVLMNKILAEAFRSKCMDVKASSAPGIHQEVPSGFVQQLLQRSSQPAIVTGLSSAGQPTSGQQIAIPSAHSTSSLHAAHHSPGHLSGNLTRPPHINNISPATGNLQIGSEIRCPAPHLQPFRPSASTTPSLAVGTSSQQVPSNPPTTSSPPFQPAFRPQPSTQQSHPHNNAHGPETTRFLPPLSRSSLSEIELLMEVDNQTNTNTNTNPSSNLRPLPSLGSDSDPVVRPELVLLNNTRASEACPSEVVCLSDDD

SEQ ID NO: 700 - protein, 1610 aa, Glycine max
MRVDTGLSGSVKDLVENNMTLGSLAPSNVALPSEDGKSKEMRVDTGLSGPVKDLVEDTMTLDSLAPSNAATYETGLAPESIHPDYCREETLQVLVSSNSILDEDSIRNSVGDDRGENLIPSKSKEITVDVDSDVSAMLAKGDNCNLTPDASSLSRLGGYIMGTDCPSNATLYETGLLPERVQPDCCREETLPSSNSKNGVLPSEDGKSKETRVDSGLSVPVKDLVENTVTLGSLAPSTAATYVASLAPESFQTDYRREKGNSILDEEDLISNSVGHDSSGETLVPSKRKGIMVDMDSDVSAMLAKGDNCNLVPDSGSPSQLGGNIMGIDGSCSKRIRSDYNPIDSESCIPSATELQDGDYIDASMLQKDSQIDNEKEPGLINNSNNSVTQLKERLSSHIGYRCKFVEYWVPVQISNLQLEQYCSILLSNASILRSSSKVDSVEAVRDVLISTRKCCSHPYLVGPELQPSLNKGLKPIEYLDFDLKASGKLQLLDSMLEELRKNDLRVVILFQSIGGSGRVIGNYLEDLLRPKFGSDSYERIDKSLPPSKKNAAMKKFNDKNNKRFVFLLETCACLPSIKLSSVDSIIIFDSDWNPMNDIRSLQKITLDSQFELIKIFRLYSSFTVEEKALILSKQCKIFDINSPSWTTCHMLLMWGASCLFDKLKVFHDGETSASNVKSLFGRPLLKEAMHEFSSLLSQDGEHIESSNFSTLLEVQQNGATYHANSSLLGELKLRVLGEEPPQIFWTKLLEGKQFQWKYLNSSSQRSRKKVHHFDGSVNRPDLVNEGAAKKRRKVSNNIVDQLSKSEDEKLSNGIKAGTSGDLLDGSQGNNAESEQKSGQHDEQRSLLLLLKPEIRKLCDVLLLPDNVKRMIDNFLEYIMSNHDVNREPFSILQAFQLSLCWTAASLLKHKLDPIASLIQDLNFECKKEEVDYICSMLRCLKKIFLYRTGNHHDTGSPKASGPSNRAYSRTGVAQVVELFKKDMSKSIKEIQKKCEKKLKKLLLLQEEEKQRLRAAIEEEKAKFEERYKIESAVIRSCSPNDVTRMEKLRVLNTEYVKGIEELKFQHDTCLKDLKDKQLAEIQKFQDKEAAWVKDVKSWADKEYLNIVASEELGTGVESLQTCDQVKPDNGLKNHLAGTAAKPPSSMEQKSDGGVVNELSDRELRLSNCPDNNTLLSPRNQNSGAPSNIPGLDRVLSPRACQAASSSDGPNTISFPNPLLEQQTTDGVPLSIPAAADCRDDIEHLTNAVLGDKRITSDQQKGAPETITELSQGTPVSRTVNVLDPPEQVQQLSVGSSPDHDTSGEMHVQRLPSAELPSSHLDSTNLPLTTEIEHQPTVVPNQDVQPDSNLELYSHSHEVVVHPASNSDPNTVTPSEVRVQSADTINLSIPLEINYQHMQAETHSASRMLHLSYDPLNNELDRIQKVTEQTMKNYEDKKLLLKTDFEKELEELRRKYDIKFQGIEVEFKQRKMALETNRNVVHMNKFLADAFRSKCSTLKSSCTSGMLPDSDIAQQQLLQPSRQQSASWRSLVNGSSSCGPSATSLQSPSTTTGSQHMVTPIRPGYSASVFPSNVSARSPIINTISLSVGNPQAGGGQIRAPAPHLQPYRP

SEQ ID NO: 701 - protein, 2254 aa, Zea mays
MANTRSGGGGDAPPPPSSPPAAASATATRKLADGRETRNTAAASAHTPNLRRSTRENKGKHKSRLADTPPLHRSAKTPTKDATAIATPKSTPLPNNPKDSTKKPSRVRNTSVSPSPSKQEPNETSTPASTKRKTQDDALTASTPSKKQKRLLHAKSYIALFNIGEESVLATLREDEEKASEVQPEGDGAVLVHEESNAPEQPNQEASNVVASEVLGGHSSDLHEIEVILEGDGLKIGSHQSDVVLERCILTETRSLNKAVESIPMLETGEQATGGSNQKPLLELPNSACSTAHHEEASKSVEDGNSIGIQGACTSRNTEAIQCDETWYDDNICVVCRSREISDILKSCGGKGCKRHYHLSCMDPSLDVSLGIWLCIMCMKKRIQFGVYSVSEGIESLWDVKEGVVNSKQYFVKYKNLAHVHNQWVSESDIVDSTPQGSDLISKVSKKIHKEKTIRWKQEWAEPHRLLKRRLLMPQKEAEVFFNSLGDKFVYCNVEWLVKWKDLGYEHATWELESSSFLCTPEAEELKRSYEDRFKTARKASDPSKVDKAKGGIFQQLERLPDGCPPGLDDDHLRSLNQLREFWHNSCGAIFIDDQERVIKTILFVASILPHICQPLLIVSTTTTLSLWETKFNRLAASINVVVYNGEKDVRKSIQDLEFYQDGSVMLQVLLSHPDAILEDIEVIERINWEAVIVDDCQNSRVSKWLEQLRRLPTNFRMVLLSSSLKESIAEHISLLSFLNPEENGTLSVSNGVSFDTAGTLVVLKEKLARYVAFERKTDSSKLLEYWVPARLSPVQLEMYCYILLSNSPALRSHSKTDSVGALRNILISLRKCCDHPYLVDQSLQSTLTKDHPVTDILDIGVRSCGKLLLLDRMLQQIRIQGLRVLILSQSGGESGKPMGDILDDFVRQRFGYESYERVERGLLLQKKQTAMNMFNDKTKGRFIFLIDSRACGPSIKLSSVDAIIIYCSDWNPMNDLRALQRVSMESQSEPVPIFRLYSSFTVEEKALILAKHDHILDSNIVNITPSLSHCLLSWGASFLFNRLEELQQHSYSNVSGDELFMDNVDLEFLTKLLSKVELRTESGNTAISQAYLCGSFYSRAIVVAGEREGIPSVDGDLPKFWAYWLSLLNGRSPQWQYISEPVQRSRRKINNMEQQLKNTDKQLKITTEETDEARVKRRRIGEIMDSSAIDSPGKNKDTILPGNNTPPSSHQISVEDTWQELERSNLHATQKGLHVQLKPEISKLYKLLQLPEKVKSLCEEFLEYILKNHQISQEPKGILHAFNLALCWRAASLSKHKINHTESLALAVKNLNYECKEELVDFVYGKLKILKKKFARRAGEVSKQNYMVSVSDISTCEQVTSVRLRNDELVPSQVTLTDGNFENGSHHEATGDFWTEEMVSGEKELLPDPVTHEGEHLLRDELLSKIMDKRIKLVDKVFSLRGRSIYDKHSNQVSFLDMHRQKVVDKLRRACSLVVEHLRSSQNHIAQEDRDGKIKLIIEWFTMLLYAFLEHMKCQRNRLDMQQSASRIKESQLKEETLQAARCGQLDQNFDQHIPSPDFEFAMEEFRHFREVVGSCYVDPAALVPESLDDNSAMEIMLVQSATDAEVIEEVLNRPTEVLVQGPASEVVGPSVDVICNCSDGINSQRDASLAVHSLEPSSDDLRSTDHVEENTVGSQIQGGTSKHLGDAAMEVETGNRNTALADSPHFDKPALTAPSRQATLLVSRETEMLSNLVDQCAQQSLVSAQPLQDESEQADLSSAASTQPLQSERQQLISVSNNLLERAQLDQSQPNYQTDAAPGCAQSTELFPVTSMMFNHAPIDSEPLKNELHKLRLHMDTLNKVHEMKKTQLQTACSQELEKVKRKYDLLIKEHDSTHLQQKKALGDFYEKVQRNQSLAEDFRAKFISLSAAQGAAKGHTPPVRHTPQATQVVSSTSSIALSSACRPPVPRPRVQAPQVDQPLLSLSQFSRPSLQVVQPPNLELGNLFRATSTTLSHMPPQRGSYGVQSELAPRSPAPHLQFRSPRAHSMAPGNQQQSPAISVDAMSSRTQPVLAASTSPSDIHVGPLAASALSSLHSVLPSTSLPSSLHPSHLAQRVPPTPNPTLQAGAPKGSNATMPSIPTGMQLPDSGSLSLDAWLTANLGLNDASTAPAKDTASLGLSSDAPRAAPDTNTASLGLSSDVPRGTAPATNTASLGLSSDVPRGTTPATTTTSLGLISDSPRVIAPASSNSPGAIASATNGGSEIDVVCLSDDE

SEQ ID NO: 702 - protein, 2265 aa, Sorghum Bicolor
MANTRSGGGGDAQLANGRETRSTTAAAAAASAQTPNLRRSTRENKGKHKSRQLPATPSSRRSAKTPTKDDTAIATPKSTSSPNNPKDSTEKPSRVRNTSVSPSPSKHDSNGTSTTASTKRKIQDDAQTASTPSKKQKRLMHTKSYVALFSTGQGQPESQVLAPLRQDKEKASDVQPEGDGAVLAHEESNALEQPNQEPSNVSAGKVLGGHSSDLHETEVILEGDGLKIGSHQSDVVLESCILTETCSLNKAVESIPMLETGEQAIGDSNQNSLLELQNSACSTAHHEEANKSLEDGDSVGVQGACTSRNIEAIQCDETGYNDNICVGCRSREISDILKSCGGKGCKRHYHLSCMDPPLDVSLGIWLCRMCIKKRLQFGVYSVSEGIESLWDVKEGAENSKQYFVKYKNLSHVHNRWISESDIVDSTPQGSDLISKFSKRIHKEKTIRWKQEWAEPHRLLKRRLLMPPKEAEVFFNSLGDKFVYCNVEWLVKWKDLGYEHATWELESSSFLCTTEAEELKRSYEDRFKAARKASDPSKVDKVKGGIFQQLQRLPDGCPPGLDNDHLRSLNQLREFWHNSRGAVFIDDQERVIKTILFVASILPHICRPLLIVSTTTSLSLWETKFNRLAASINVVVYNGEKDVRKSIQDLEFYEDGSVMLQVLLSHPDAILEDIKAIERINWEAVIVDDCQNSRVSKCLEQLKRLPTNFRMVLLSSSLKESIAEHINLLSFLNPEENGTLSVSNGVYFDTAGTLAVLKAKLARYVAFERKGDSSKLLEYWVPARLSPVQLEMYCYILLSNSPALRSHSKTDSVGALRNILISLRKCCDHPYLVDQSLQSTLTKDHPITDILDIGVRSCGKLLLLDRMLQQIRIQGLRVLILSQSGGGSGNPMGDILDDFVRQRFGYESYERVERGLLLQKKQTAMNMFNDKTKGRFIFLIDSRACGSSIKLSSVDAIIIYGSDWNPMNDLRALQKVSMESQSEPVPIFRLYSSCTVEEKALILAKHDHILDSNILNITPSLSHCLLSWGASFLFNRLEELQNPSYSNVSGDELFTDNVALEFLTKLLSKVEPSTESGNVAISQAYLRGSFYSRAVVVAGEREGISSVDGDLPKFCAYWLSLLNGRSPHWQHISEPVQRSRRKIYNAEQQLKNTEEQLKIPTEETDEARIKRRRIGEIMDSSPKDSPGKNKETTILPENNTPSSSHQISVEDTWQELERNNLHGTQKGLHVQLKPELSKLYKLLQLPENVKSLCEEFLEYILKNHQISQEPKGILHAFNLALCWRAASLSKHKINHTESLTLAVENLNYECKEELAEFVYAKLKILKRKFARRAGEVSKQNSMASVNNISTCEQDTSVRLRNDELIPSQVTLTDDNFENGSHHVATGDFWTEEMVSGEKELLSGPVTHEGEQLSRDELLSKIMDKRIKLVDKVFSLRGRSIQDKHSNEVSFLDMHRQKEVAKLKGACSLVVEHLRSSQNHIAQEDGDGKIKLIIEWFTMLLYAFLEHMKCQRDKLDMQQSVSRFKESQLKEETLQAAKRGQLDQNFDQHIPSPDFEFAMEEFRHFREIVGSCHVHAAALAPESLDDNSAMEITLVRSANAPEVIEEEALNRPAKVLVQGPAPEVVGPSVNVICNYSDGINSQGDAYLAVPSLEPSSDDLSTDHVEENTVGSPVQGDTSEHLGDAAMEVETGNRNTALADSPHFDTPALTAPSRQATLLVSREIEMQSNLVDQCAQQSLVSSQPLQREPEQADLSSAASDQPLQSERQQSIPPPNNLLERAQLGQSQPNYQTDVAPGSAQSAELFPVTSMMFNHPPIDAEPLKNELHKLRLHMDALNKVHEIKKTQLQTECSQELEKVKRKYDLLIKEHDSTHLQQKKALDGFYEKVQRNQSLAEDFRAKFISPSAAQGAAKAHTPPVRRTPQATPQVMRPPLLDSASSIALSSACRPPVPRPRVQAPQVDQASSSLLQLSRPSLPSLQVVQPPNLEQGNLFRTTATTLSHMPPPRGSYGVQSELAPRSPAPHLQFRSPRAHSMPPPGNQQQLPATRVEAMSSRTQPMLAASSCPSDIHVGHLAASAMSSLHSVLPSTSLPSSLHPSHLAQRVLPTPNPTLQAAAPSGSNTTMPSIPTGMQPPDSGSLSLDAWLAANLGLNDDASTAPAKNTASLGLRSDAPRAAPATNTASLGLSSDVPMGTAPATNTASLGLSSDVPRGMASATNTASLRLSSDSPRVTVPATSTASLRLSSESPGATAPAINGPEIDLVCLSDDE

SEQ ID NO: 703 - protein, 1274 aa, Oryza sativa
MPRKKASSPSPTSTARETRSSSARGHASPTPTPTLRRSTRETTSRFSSSSSSSANKHEGSPAKQSANNNTAKRKMNNAAADTSTRPIKKNKKLNAKSYLALFSTPQQTAKSPPAPAPPLLVQVDDDNASTVPMQDSGTLLEHEEADTQEQGYQSGLHKVPEVVLEETDVSKNKADEHASTSEPLIPVDLCSNDNASESSHGMEVKEQTVGCSNPCFVTDLPNRPCSIVHHEEAKKTIEAGDPREIKGASTSNQALVTHSDGTDYNEYLCAVCRSRETPGILKSCDGKDCKNRYHDSCLDPPLQYVSLGIWLCTLCTKKRLQFGLFAVSEGIESLWDVKEGVQNNKQYFVKYKNLAHVHNQWLPESDIIRTPGGQDLINKFCKRIQKEKTIRWKQEWAEPHRLLKKRPLMSEKEAEEFFNSLGDKFAYCNVEWLVKWKDLGYEYATWELETSSFLCTPEAKDLKRNYESRHEDARRGFDPAKINKGKQCLFQKLQKLPDGFPPGLDKDHLSSLNRLREFWHNSDGAICLDDQERVIKTILFSMSILPDVCQPLLIVSTSASLSLWEAKFNRLAPSINVVVYNGEKDVRKQIQDLEFYENGLVTFQVLLSHPDAILEDIQTMESIVWEAVMVDDCQSLRVSKCLEQLKHLSTNFRMVLLSFPLKESIPEYINLLSFLNPEGSVISSSSNGDFTDTGDILATLKEKFARHVAFERKADSSKFLEYWVPARLSRVQLEMYCYTLLSNSPALRSHSRTDSVGALRDILVSLRKCCDHPYLVDQSLQSSLTKGHSLTDILDIGVCASGKLLLLDKMLQEIRNQGRRVLIVSQSGGGAGNPMGDILDDFVRQRFGFESYERVERGLLVPKKQTALNMFNDKTKGRFIFLIDSRACVPSIKLSSVDAIIIYCSDWNPTNDLRVLQRISIESQSECVPIFRLYSSCTVEEKTLILAKHDHILDSNVQNVMPIVSHSLLSWGASFLFNRLEEFQKHDYSSKDSEDDGLFMNNVFLEFAAKLSTNVEASTKMENAVISRAQQSGSFYSRDIAVISEREGISAVDGDLPKFWTFWSNLLGGRSPHWQYISEPVQRNRRKIQNMEDQMRIPAEETDEAIMKRRKIGEIMDSSPKILPVKDNDAVLPENSTASSSHETSVDDTWQELGAESLQGTQKGLHTQLKPELSKLYELLELPETVKCLCEELLDYILKNHQVSQEPKGILHAFNIALCWRAASLLKHKINRRESLALSVRNLNYECDEVLAEYVYEKLRILKKKFSRRASETS

SEQ ID NO: 704 - protein, 2244 aa, Brachypodium distachyon
MANTRSGAGAQKDGAGDTGAGTSSTRKASAATKAKAPKSAMASTSSASELESRSSARQASDVQEPNLRRSSRETRGKNPNLKGAAGPSTPVSQKSTRGADTPKSSAKKLKGVAELTAKASTPRMSNRVKNSSVSGSTASNDSNGISSLVATPNKTAKRQIDEHDSMKNKHDGSESGSRPLKKQKRLTGRNYAKLFKKCSEVNEISPVSAPKVDEGNISMAHTEDNVSVSVYEESDAQEQDNQARLSQAVNKISKGSTSGLHEAPNMTLETDWNSAPVSEALMPTDLCSEVNVADSSLAMEAKEQTDGYSNESLVPESPNSPNSNIDSNEAKKSIEEDYSIRIQEACALKQTEVTQCDETDCDEHICVVCRSAETPGILKSCDGNVCKRKFHISCLGFPLECFSLGIWLCSICSKERLLSGVYTASGGVESLWDVKEGVQNCKQYFVKYKNLAHVHNRWTPESDIGHDLVSKFSKKNQKEKTIMWRQEWAEPHRLLMKRSLMPPKEAEEFFHSTGDKLAFCNVEWLVKWKDLGYEHATWELDTSSFLCTGEAEELKRNYENRHEAARKASDTAKIKKAKQSPFQKLRRLPDGCPPGLDNVHLSSLNQLREFWHNSRGAILVDDQAKFNRLAPYINVVVYNGEKDVRKTIRDLEFYDNGSMMLQVLLAHPDAILEDIETMKCIVWEAVIVDDCQISRVSKCLEQLKHLLADFRMVLLSSPLKENIVDYINLLSFVNSEGNDMSSISNVNSIDTPGTIAMLKSKLALHVAFERKADSSKFLEYWVPARLSRVQLEIYCYTLHSNSSALRSHSKTDSVGALRDMLLSLRKCCDHPYLADQMLQASLTKDRPATDILDIGVHASGKLLLLDKMLQEIRGKGMRVVILSHVQPGAGAGNPMGDILDDFVRQRFGFESYERVERNLPAQKKHIAMSMFNDKTKGRFIFLIDSRACLPSIKLSSVDAIIIYCSDWNPANDLRILQRISIESQSERVPIFRLYSSCTVEEKALILAKHDHVLDSNIQNITPILSHSLLSWGASFLFSRLEELKNNTYSSKDSDAEKLFMDDVLLESLTKLSTKVDISTKVSNAAISQADLSGTFYSRDIVLSGEREGISAPDGDLPKFWTFWFNLLNGKFPRWQYITEPEHRCRRKIQNMEEQGKVPANETDEASTKRRKIAEIVDPSPNVLAGKDKGSMLPENYMASSSQQISVGDTWQELGVENQHGTQKGLHVQLRPELSKLHKLLELPESVKCLCEEFLEYILKNHQVTQEPKGILHAFNIALCWRAASLLKHKVNRRESLVLAAKHLNYECSEDLASYVYDKLRILKKKFSHRAGGTSKHNQSTSVKNIPPYQEEISPKSGYDEPTVATVEGNLENGSHQEDTHDLLIEAIVPGEKEMLFVPEAHKNQHLSKDVLLGRITEKRIHLVNMVFTLREKNIRETQANEVAMLDMHRHNRVIKLREACKIVVEHLRKSHADPGRDCQIKLIIEWFTMLLYAYLEHIRYQHEKLYLLQSSVWTKELQLKENFLQEAKFGQLGDTFDQHIPLPDSGFSMEEFSHFSCCVDTFTLANCSQSLDDISAMEITLVRSVIPSEVTNAEVARNGSAEVLIHTEGGPASEGSGLTENRIQSNSDVIDSQGGASLTVQHEFSSSSVFHNSINQASSGGEHRGTEHVEGESGVGLQPLLGGTNQQIGGAGMEVNTSNGDSTLADTPHIEPPQTMAPVPGQASLQMSKEVDAIAMQSDQSSVALAQPLQEEAEQAGLCGSASAETLQSETQPSSSREIETQANLIIQSAQPSITPAQLPRREAEQAGLSHVASAPCMPTGMQPMTQVSNILLERTRPDLSEPSHRPEVAPGSVQSAQLFPVASMMFSHPPVGDEPLKNEVHRLRLYIDSLNKTHELKQSQLQTECTQEMEKVKQKYDLLLQEEDSTHLQQKKTLDDLCEKVLLNQSLADDFRAKFISSSGAQARAHSPPIRQAPQASQQIPTRPSGVTLTAPPIVSSSPGRSPLQVDRPSSLLQVSRTSSPSSHTVRPGPSIPANLVRSASAPFSQTPAASRGSYGVQGELARAPAPHLQRRLPPRAHQQQLPTRLEGASARTQSTPATPVRQSPSHALSQGNPSPSSSLSSSHPITPAAVRPSSPHQTHQGPPPQSSSSNPTRLLPPLSSISCASAQLTPPPGFNTSSSIVSSVASNVLPSGCVGPSVSGTRQSDSDSVSLDKWLNKNLGLSSEPPGATAGTDLVCLSDDDE

SEQ ID NO: 705 - protein, 2283 aa, Populus trichocarpa
MGNDTKASRKAKAEESKNNDVKGRNIASRSSTDKSGLRRSVREASSKKNVTPSPSSTRKSERLEKQTPTAPPATRKSERLVEKQSLSSPLRRSERGKNQSSSSSSGSKKSGKKSSSSVMKKKQKKEKSVKQLETKDVGNDKKHVIKAVLVETKRMDARAYKALFKRQQKKANLEGRCEEMKNKNADGNDCRDGASENVNGGSECSQRKVEELIDRCVLRDSEKNLEGNSIASEPVKEVLENNGGPKPPLKSQKLTFLEKDHQFKEGDSREDLNSDDSVLLSAQRTLSEPENDVAQMEQEQLPAELVDLTVNRTPRVDTEVESGYKEMPFKRKRSIEDLNSDATTMVSNKVADAAPYENGRTDSVAKCATSSKRQRCCDGQGCKRSYHLSCLDPPLGDVPLGVWHCLACVRKKIEFGMHSVSKGIESIWDASEVEVADDNGVQRQKQFYVKYKGLAHVHNRWLPENQLILEAPSLLAKFNQKNQVRKWKQEWIVPHHMLQKRSVMFPNQHVENFSHHASNILACQFEWLVKWRGLDYEHATWELEIAPFMNSPEAQSLIRDYENRLVKAKGAEYLSIIDKLSAGGSPEFDYNHLDFVNYLHDYWLKGENAVLIDDQEQITKVISFILSLSSNASWPFLIITTSASLHSWEEELFRLAPSLYAVVYHGNKDIRKSIRKLEFYSEGGCIMFQILVTSPEVIIEDLNVLESMKWEAVIVDECQSSRIFSHFKQIKMLRTAMRLLLVNGQLKDGITEHLLSLLVHQSDLNGSEDLVTNLSPKTGNLKDQLSKYIANSPRPDPSRFKEYWVPVQLSLMQLEQYCATLLSKSLSLCSSSRNDPVGALRDILISCRKCCDHPYIMNPSLQISLTKDRKEADILDIGIKASGKLQLLGEMLFSIKERGLRALVLFQSSGGSGKDNIGDILDDFVRQRFGQGSYERVDEHVLPSRKQSALKFFNNHQEGRFVFLLETRACSSSIKLSSVDTVIIFASDWNPMTDIRSLQKITLHSQFDQINIFRLYSSCTVEEKVLIIARQDKTLESSLHSISRAASDMLLMWGASYLFEKLSEFHCGNDTASSGNTLFEQSHLKDVIQEFLTIIIQKGKDNTPSNSIILKVKQNQGIYTTNFPLHGERKIQLLDEELPHIFWKKLLEGKQPRWKYSSGLSQRNRKRVQYADDIQKNTVVEGDEVVKKRNKVANNSTNSPSLKAALIGTSGAPVLNMSQFLPSSTGRLNTTATNHVSNFRHSNSNSSEVLKANKVEYNERMNLHDSEKSLHLILKPEITKLCEILQLPENVKVMVERFLEYVLNNHHISREPASILQAFLISLCWTSASMLKHKLGHKESLALAKQHLNFGCKKDEADFVYSKLRCLKKAFLHHTGTYKVATSPKAAEFSTEDHSKNQSNGRSSLSTPSNMQKGRIEVENLRPSQEFSIDQVVSHLGLAQKDYSKSIKDIEKKCDKQMRKLLQRQQEEMEEFEKKYEEEKAELEHMHRTEAAVIRLHSNILERTDKLKVLDNVYAKKFEDLNWQMDMHLNNLLELQLATRNKLQERKAQWIKGVKSWAHAELIKKPTANESGYNQENFVTWNSCCKEQTPERSRSMPDDVPLEVPETVSSSEDVLPGVLATSKPSSDGATSSMLDREVPLEVPQTATVRGVSEDVMSANSFPCEEQIPDLQVTLRVLEANCSSDGPENTIHKSSSEKGSDRVTLTVPDREFSLGVTGIVTSIGGLENAASVNPSPSEGQPHARSTSCMDVREVLLEAPETASLEAEEDVNRIMEKDGVSGMVSDNAIEVDQWNGVVCILNQEPHYDDMVAVNQQTGEVRLGVPENNVVNQQHEVDPSGVREAGVGHNQLEIDSMHVVASDNGQPTESSRLQDRVARVCNNQIAFQQVDALASQPFVASDHSHSDAPVTELLPSMDSSAGSQPTTSFAEHAPANSIAVGESGTRISNTMTAPVTSIISNCPVTAPAVRMPVSMSQDPLQNELDRICRETEQIIKIHEDTKLQLKSDCEKEIQEVVAQIRTKHDIKLQEIESEFLRKKKEMADNQNKVFLNKILAEAFRSKCMDNKASSTPVRQQEINSSIVQQQLQLSEPTARPYIVTGLYSTALPAASLQTTPTSSPPAPPRQVVHSSGRFSSTSTRPPHISSISPATSNLRIGNEIRAPAPHLQHFRPSARGMQSQQVSTTSPTPSEIPSRGPATAQQSSPQTTTNSGESMGISPSMTSLQGLESLMDIDNQTSTNATQAWSSPPPTDLSSDSNPLAQPKLSMLNSVLTNPISEVVCLSDDD

SEQ ID NO: 706 - protein, 1957 aa, Brassica napus
MKKDEKKKVSTGRTICTRSSAVASASTVLETTPLRRSTRGTPSTKPITPASSTRRSGRLASSPASVTKISGGTEKKPTASPLRRSGKGKTVASENPKGLSDKPDRNANTSSLGVEESNGKRIDIIEEESTDEIKKGKPEMTARSLRALYRGHLNTGSNASSNDEELVVVGCSRRVPAENDDARDDNSPPHANSGSKGLPVGDFSLEKGPDFPMEVARDTEKTVVDSSPMVETGDDSVIGSPSEDPEPQKLCDSETSLETDIDLALKRKRDTAENDDARDGNSPPHANSGSKGLPVGETGLEKGSDFPVEVTKDIEKTVVDSSPMVETEDGSVIGSPSENPEPQKLRDSETSLEADIDLALKRKRDTAEIVMDACTNADDRIMSTDGVIPFPPVCTNINQPERCGTCQKRQKVNDNFEDLSVCSCIAQPVQGSDQVAQDMKECGPAKSKDYGENRQKMQQDKSFDPKLLSIYTEYWVPVQLSDVQVEQYCRTLFSNSLSLSSMLKNDLVGALEETLTSVRKTCDHPYVMDVSLKQLLTKNLKLHEILDVEVKASGKLPLLGAMLTQIKAKGLKAVVFYQATHSPEGLLLGNILEDFLMQRFGQNSYEHGVCLSKKNAINNFNKESECFILLLEIRACSQSIKLLRAESFILFGSSLNPSHDVKLLEKIKVESCSERTKIFRLYSVFTVEEKALILARQNKPLENLNRPLTHALLMWGASYLFDKLEHFHGSGTPGSGVPFEQSIKDAVIQEFSSILSSHVGEENEGKLCLLLEAKHAQGSYSTDATLFGEEHVKLSDESPNMFWSKLMSGKNPMWKYCSDTPQRSRKRVRHLQGYEETTKVGNGGNLKKKKKASDDVTVDNAERKASGKDHMGHLESPNVATLKSSRGSASGTNDSLTGNGATGLYSLGCHISGVPEDMLAGIDWRQIPHESQRSLYAVLKPKMAKLCPSEDSASIAEKFLEYIIEHHRVCTEPATILQAFQIALSWIAVSLVKQTCNREESLVRAKSELGFSCSEEEVDYIYSLLCCMKSIFLGRTRSLQVDCLGTNSKQAKVNESLSGDTVRQEQSNTKSMRSSVTKDVEKTISDIKNKCSKKLQELVQIHEEKKVDLMNRSADKKQELQNGKKLEVLYIRVTCSGLSSQSLLDNLQRVEDDFERKNDDLKIEMNDCLKKLEGMHEAEKKKLAEDEAYWISRIENWAQAQAELIDCSPIQSGNNKHLSGLGTSNTSKNTPDVQTCNDASGEATYADTSSMVAKKNQLPEAENTLRTMSGGSTQQVHEIVASRNDKALVISPVSHEQPTDNVATKRQPNELASLSAPDILIPAGCQEESGALNVQSSEYPNCVRVTSAAPDEDVPSRVAEISQSVANLAKSASLESWLNREEALVSIENDKTIHSGSDTDNIFDHQYEEACSLYKEISDELVSPIPHPAPVLKTRDSAESHQGDDEICPLPSSPAGQQPDPAEKNQGKNVEASIESQPAVSESVETGGFAAFEQGDQVACPLPSSPTGNQPDSGANVESQNISTSEEPHNAGPGVVETGVTAVSDQEIMGAQDPCSLPTPLIGTQADLATNTEGQNITTVAQLHTAGSDAVETGRDASPLPVSSPGNQSEAAVSTEGLNNNTTMAAPRTTGSEACEMEVAEPDAQVEQPTFANVVDEGVVEPPAGVTAPVSSQLNNATGQNAPPPVPQVPFPVFSDPFRHELEKLRRESENTKKTYEEKISVLKAEFDRKMAELQAEYQRKFHEVEAEHTAKATKLQTSKNFVIMNKLLTNAFLSKCTSRMESHPSAAPRGRIQQLAQRAVQMSALMNYYTASSPAPLQPHTSSVSRSPSLPPSSTHCPMPQPRQPLISNPAPSFSASPASALNLAVNGRLVSPALHLNPYSSSSSPVPIPTTTTPTSSAVPQALTYSSSVPIPTTTTPTSSAVPQALTYSTALAQQQEQQAARTATELGKWIAEEQ

SEQ ID NO: 707 - protein, 635 aa, Arabidopsis thaliana
MAKNYTVADVVNIDSDSDSDDDNGGVIGMVPSLASLIENQKVSIADAATVAPRETLECRSFWKAGENFVIPSSVTLTAIGMVEHARVHPKFLHSNATSHKWAFGAIAELLDNAVDEIQNGATVVKIDKINIVKDNTPALVFQDNGGGMDPNGIRKCMSLGYSSKKSNTTIGQYGNGFKTSTMRLGADAMVFSRSTRGGKSTQSIGLLSYTFLRKTGQDDVIVPMIDFDISSDSPQPIIYGSPGDWSTNLNILLKWSPFSTMVELLQQFEDIGTHGTKVIIYNLWLNDEGIYELSFDDDDVDIRLRDENAQDGKRLHAKTLEVRSHISYRYRHSLRAYISMLYLKKFKNFKIILRGVSVAQFNIADEFRHPETIMYKPQAAAVDYAATGIKVGFIKEAPKLPICGFNVYHKNRLIRPFWKVVLEGSTRGNGVMGVLEANFIEPAHDKQDFERSSLFLRLEARLKRITSDYWQNHCHIFGYQTAQIPADKSKRTVIPDQPPTVNTYNPSPLPSDRISHGGPIIREINLSNATSSRTAAVAAPHLRNYTGLRNNFQPVQLNPQPPAAGDTGNNLVGKLAAEIREENLQLFMRCEEYVKKENEVEQTVKSLEKELEEIKSKCAQLALLVDAKKKEMQQV

SEQ ID NO: 708 - protein, 631 aa, Arabidopsis lyrata
MAKNTVADVVILDSDSDDDDGGGIGMGRSLTSLMENQQVSNADAATVAPRETLECRSFWKAGENFVIPSGVTPTAPGMVEHARVHPKFLHSNATSHKWAFGAIAELLDNAVDEVQNGATFVKIDKINIVKDNTPALVFQDNGGGMDPNGIRKCMSLGYSSKKSNTTIGQYGNGFKTSTMRLGADAIVFSRSTRGGKSTQSIGLLSYTFLRKTGQDDVIVPMIDFDISSVRPQPIIYGSPGDWSTNLNILLKWSPFSTMDEILQQFEDIGTHGTKVIIYNLWLNDEGIYELSFDDDDEDIRLRDENAQDGKRLYAKTLELRSHISYRYRHSLRAYISMLYLKKFKNFKIILRGIPVEQFNIADEFRHPETIMYKPQAAAMEYAATGIKVGFIKEAPKLPICGFNVYHKNRLIRPFWKVVLEGSTRGNGVVGVLEANFIEPAHDKQDFERSSLFLRLEGRLKRIISDYWQSHCHVFGYQTGQIPADRSKRIAIPDQPPTVSTFNPSPLPSDKISQGGPIIREINLSNASSSRTVAVAAPHLRNSTGLRSNFQPVQLNPQPAAADTGNNIVGKSADEIREENIQLFMRCEEYIKKENEIEQTVKSLEKELEEVKSKCAQLALLVDAKKKEMQQV

SEQ ID NO: 709 - protein, 596 aa, Cucumis sativus
MPRKTGSTPPDVVVLTSSDDEETAANTMSNKKTKSVTRLQEQRGSSTPIVSSSDKKTIDCRSFWKAGNLDFGLTGNPLPDDGDLEHARIHPKFLHSNATSHKWAFGAIAELLDNAVDEIHNGATFVKVDKVDIMKDNSPALLFHDDGGGMDPAGIRKCMSLGYSSKKSNTTIGQYGNGFKTSTMRLGADAIVFTRAVRGGTATQSVGLLSYTFLRMTNQDDVIVPMIDFDISGHWAEPIVNGSQDDWSSNLKTILEWSPFSSKEDLLIQFGDIGRHGTKVIIFNLWLNDEGIYELNFDDEDEDIRLRDEANQGGLRKLRKSVAELQSHISYRIRYSLRAYISTLYLKRFTNFNIILRGKPVEQHSIADDLKYSKVVKYKPHLHVVQASVETTIGFIKEAPAVGVCGFNVYHKNRLILPFWKVTGDGSFKGHGVVGVLEANFLEPVHDKQGFERSSAFIRLETKLKQMVMEYWKSCCHLMGYKPPGLYYLEKTKQASIGPAANIQNKLAKEQYDGPSEGSNNELNSTQDFDVSGKSYVDRICEENIELFRRCEDHATKEIKLQELVNSLEKKLKETKKKHAQLLLLVEAKRKLQNAK

SEQ ID NO: 710 - protein, 653 aa, Vitis vinifera
MSPMSLKPEKEGMDVVEIASSDDEGGVGVERRSNQQVQTDQVGQQTVVPLPPAEPPLSRSFWKAGAYDNTPSKLTPAPDQLEHARVHPKFLHSNATSHKWAFGAIAELLDNAVDEICNGATFVKLDRIDNRKDNSPALLFQDDGGGMDPESIRKCMSLGYSSKKSNTTIGQYGNGFKTSTMRLGADVIVFSRASRTSRATQSIGLLSYTFLRRTGQDDVIVPMVDFDISDHWAEPIIYSSKEDWSTNLKTILEWSPFASKEELMQQFEDIGPHGTKIIIYNLWLNDEGIFELNFDDDDEDIRLRDEANRGSLSKVPKKVAELQSHISYCIRYSLRAYASILYLRKFTNFQIILRGKPVQQFNIADELKYPKVVIYRPQHNTALKEASMETTIGFIKEAPALGVSGFNVYHKNRLIRPFWKVTSDGSSKGNGVVGVLEANFIEPAHDKQDFERSSLFIRLETKLKQMLMDYWKSNCHLMGHQPPGSRVQNMQKKHPAQSPVGHAAHIQKQLPANQHIVGLTANTKKEMNLDQPINCLTANLGQDVDNVQPGNRCRTSVREELPAVQPIIGLREGSFKEVTSADGSGLISVDKICEENIQLFMRCEEHMRKENELKQTISELERKLEEAKKKCAQLSSHLEIRRKQRILKSTEKI

SEQ ID NO: 711 - protein, 473 aa, Medicago truncatula
DPNSLRKCMSLGYSSKKSKTTIGQYGNGFKTSTMRLGADAIVFSRSTRSGRATQSVGLLSYTFLRRTGQDDVIIPMIDFDISGHWVEPIVYGTLDDWSANLKTILDWSPFTSKEELMLQFDDIGSHGTKILIYNLWLNDEGIYELSFDDDAEDIMLRDEAKNGNGKKLDKRTVQLQSHIFYRIRYSLRAYVSLLYLRKFSNFKIILRGKPVDHFDINDELIHSEVVRYKPQMAVMNEATVETTVGFIKEAPRLNVAGFNVYHKNRLIKPFWKVHADGSSKGNYVVGVLEANFIEPAHDKQDFERSLLFIRLEGKLKQIVYDYWKDHCHLVGFQPTNFRSQIGQKEARIRQSAGHLTNSRNEILADPHDICVAAEHQQIVNLHQPNEGLRATGKQCLTHEQGQGTSSGASPSVSIDAICDENIKLFTRCEEYRQKETELRKTVKHLEEELKEYQSKCAFVSSQIEAKRKQNNAR

SEQ ID NO: 712 - protein, 630 aa, Ricinus communis
MPPKLGRQPIDVVEIDSSSDDEDGVTVAATTDIKSNTKPQPQPRFQPQTQTQAPNHRGLECRSFWKAGAYDVGSTPRMATTQGQLEHARVHPKFLHSNATSHKWAFGAIAELLDNAVDEIHNGATFLKVDKIDIMKDNSPALLFQDDGGGMDPDSIRKCMSLGYSSKKSNKTIGQYGNGFKTSTMRLGADVIVFSRASRGSKATQSIGLLSYTLLLKTGQDDVIVPMVDFDVSGHWAEPIIYSSQDDWSSNLNMILEWSPFTSKDMLMQQFEDIGPHGTKVIIYNLWLNDEGIYELSFDDDEEDIRLRDEANRGGQIKLNQKTVELQSHISYRIRYSLRAYASILYLRKFTNFSIILRGKPIQQYIIADDLKHSKKAIYRPQLGVTSKEVAVETTIGFIKEAPNLGVSGFNVYHKNRLIRPFWKVTGEGATKGNYVVGVLEANFIEPAHDKQDFERSSLFIRLEAKLKQMLMDYWNNNCYLIGHQPPWIRPNTLKHTAKSHRQLPTNQHDAGFSVNAGEEIHLDQSLNDLSANLLHLPEDHPVTFSATGSYDEVSEDGPGSMLADQICEENILLFMRCEGHRQKQIELKHTITELEKELEQAKRKCAQLSAHLETRRKQKTVKEQTEKIT

SEQ ID NO: 713 - protein, 659 aa, Glycine max
MSLLPKTEQNDVPVVDIDSDDDGGAAVAPAKNDASSHKTPSPQVELVQQETPSSSSSLSASDGLSRSFWKAGDYVVGPSSKPAPFQGHLEHARVHPKFLHSNATSHKWAFGAIAELVDNAVDENQNGATFVKIDKLDVKKDNSPALCFLDDGGGMNPNAIRKCMSLGYSSKKSKTTIGQYGNGFKTSTMRLGADVIVFTCVTSRATQSVGLLSYTFLRRTGQDDVVVPMIDFDISGHWAEPIIYSSQHEWSANLKTILDWSPFTSKEELMLQFDDIGSHGTKVVIYNLWLNDEGIYELSFDDDAEDLSNSWYPSRNRDRVSREKDLKKGFLKLINGYYAERWATHGAEKNLCKKTVQLQSHISYRLRFSLRAYVSMLYLRKFSNFSIILRGKLVDQFNIVDDLIYSKVIPYKPQLAMASNEAIVETKTTIGFIKEAAEIKVTGFNVYHKNRLIKPFWKVVADGSSKGRCVVGVLEANFIEPAHDKQDFERSVLFIRLENKLKQMTMDYWREHCHLVGYQPPNLKSQKNVVKEAHIRKSAEHSTNPQNQLLADQQDTSLVAEHQSGLSQSVVGLAVTGMQGLRHEHLGTIVETPGSVSPDEICAENIKLFERCEEYRQKETELKQTVVDLEDELKQIQKKCTLLVSLVETKRKAKSVKGQ

SEQ ID NO: 714 - protein, 676 aa, Zea mays
MSLGAEVIELSSDEDEEPVPSTTALIHHAPSSPPDVKPHLLADVDVKPLLLLPPPLHPPGYGALVPVKTEEPVPVATVSSPPRALPPPRLCRQFWKSGDYVVARRNPDVAGPGGRNRLRINPKFLHSNATSHKWAFGAIAELLDNAIDEVNNGATFVRVNKFKNPRDGNPSLLVQDDGGGMDPEALRRCMSFGFSDKQSDAFIGQYGNGFKTSTMRLGADVIVFTQNQNNWVPTRSIGLLSYTFLMETGCDDVLVPTVDYQYDLTTTSYVQMLRHDQKLFSSNLAILLKWSPFSTEAELLKQFDDMGDHGTKIIVFNLWFNDDGDMELDFNSDKKDILITGAHKKVKTNSLDKIAAQNYVSTRLRYSLRAYASILYLHVPDTFRIILRGCDVEPHNVVNDLMYRECVLYKPQIAGLTESSVITTIGFVKGAPDIDVQGFNVYHKNRLILPFWKVANNSYGKGRGVVGILEANFIKPTHDKQDFEKSVLYQRLEFRLKEMTYEYWDLHCHRVGYDNKKLPKATRAINRANHMNGGSSPTSAPPRLLAVDIPTSSSSIPRLSASAAREKISSLDSLPKSMIGLKRKFNPFGAVAASADQDGLHHMDKIDVSQRRRFNEYKTLTLENDKLRNECLQYEGSEKQLVLKEQKLRSEIAEVEKKYQELLGELRSLDVKKEKQ

SEQ ID NO: 715 - protein, 599 aa, Sorghum Bicolor
MPLAMDGGGGGGGRALDCRSFWKAGAYEAPTAPTREFQDALETGDFDRARVHPKFLHTNATSHKWAFGAIAELLDNAVDERSNGATFIKVDKSINLKDNSSMIVFQDDGGGMDPEGVRRCMSLGFSTKKSKTTIGQYGNGFKTSTMRLGADAIVFTRAIRGSNVTLSIGLLSYTFLRKTMKDDIVVPMLDFKIQDGDIVPLVYGSQGDWDSSLKIILDWSPFSSKEELLQQFQDVGSHGTKVIVYNLWMNDDGLLELDFEDDDEDILLRDQGSASGGFSKSQKEIVMQHISHRLRFSLRAYTSILYLRKFDNFQIILRGKPVEQLFITEELKFKKVVTYKPQAAHDSQVAPVKIDVGFAKEAPILGIFGMNVYHKDRLIMPFWKVLQEGSSRGRSVVGVLEANFIEPAHDKQDFERTPLFIRLEARLRQIIIDFWKERCHLIGYQPLDPQLRSQYKATLKDSGGPGTQVHHKASSARRTGGLSSNLLPDTYDDITTVGLANNGSHSQSSGQAQENNMESEGLDEDLVEIGSSGVLDPNFIEKLSEENIALFSRREELRQRDTQLKQTIGGLEHELEETKKKCGQLAAQLKAWKNQQHLP

SEQ ID NO: 716 - protein, 629 aa, Oryza sativa
MAGGTGGAGGGGGRALDCRSFWKAGAFESASAPSREFHDALVAGDFDRARVHPKFLHTNATSHKWAFGAIAELLDNAVDEICNGATFIKVDKSVNLKDNSTMLVFQDDGGGMDPEGVRRCMSLGFSTKKSKKTIGQYGNGFKTSTMRLGADAIVFTRANRGSNVTLSIGLLSYTFLRRTMKDDIVVPMLDFKIQDGHIVPLVYGSQGDWDSSLKIILEWSPFSSKEELLQQFKDIVSHGTKVAIYNLWMNDDGLLELDFEDDDEASLHIIFVAIMACFLIDQRCKLYKDILLRDQDKASGGVTKAQKEIVQQHISHRLRFSLRAYTSILYLKKFENFQIILRGKPVEQIRIADELKFKKLVTYKPQVAHDSQVVSVKVDVGFAKEAPVLGIFGMNVYHKNRLIMPFWKVLQEGSSRGRSVVGVLEANFIEPAHDKQDFERTPLFIRLEAKLRQIILDYWKEKCHLIGYQPVDPQLRSQYKAALKDSGNPGPKSQQKASTSRRTGGHTSNLLPETYDDTEVIGLTANGSGSRVRSFGQAQENSMEPVGLDENSVDIGSEGALDPYIMEKLSEENIGLFTRREELRQRDTQLRQTVGELEQQLAETKKKCAQLADDLRIRKSQQQQQPPYI

SEQ ID NO: 717 - protein, 602 aa, Brachypodium distachyon
MPAVMTGGTGGGGGRSLDCRSFWKAGANEGPSAPIREFHDALETGDFDRARVHPKFLHTNATSHKWAFGGISELLDNAVDEICNGATFVKVDKSISPKDNSPMLVFQDDGGGMDPEGVRRCMSLGFSTKKSKTTIGQYGNGFKTSTMRLGADAIVFTRAIRESNVTLSIGLLSYTFLRRTMKDDIIVPMLDFQVQDGHIVPLVYGSQGDWDSSLKIIIDWSPFSSQEELLQQFEDMETHGTKVAIYNLWMNDDGLLELDFEDDDEDILLRDQGQTSGGSTRIQKEIVEQHISHRLRFSLRAYISILYLRKFENFQIILRGKPVEQISIANELKFKKVVTYKPQVAHDSQAVSVKVDIGFAKEAPVLGIFGMNVYHKNRLIMPFWKVLQEGSSRGRSVIGVLEANFIEPAHDKQDFERTPLFIRLETKLRQIIIEYWKEKCHLIGYQPTDPKLRTQYKAALKDSGDGARIQQKASTTRKAGGHLSNLLPDTYDDVAVVRLTANGAGSGLQSSGLALQNNMESAGLEEDLDIGSHGVLDPNFNERLSEENLALFTRREDLRQRDTQLKQTIGELEHQLEETKRKCSQLAAELQKRKSQQQLPYM

SEQ ID NO: 718 - protein, 657 aa, Populus trichocarpa
MPPKVEKQQPMNVVEIASSDDEVDIGPPPGMPRKTTPSSSKSRRQQPQKQQQQKQQQQQKQQQQDSSSEAIAAPVPAYQSLDCRSFWKAGAYDVGPIASKAPAQGQLEHARVHPKFLHSNATSHKWAFGAIAELLDNAVDEVHNGATFVKVDKIDIMKDNSPALLFQDDGGGMDPDGIRKCMSLGYSSKKSNTTIGQYGNGFKTSTMRLGADVLVYSCATRAGKATQSIGLLSYTFLRKTGQDDVIVPMIDFDISGNRAEPILYGSQDDWSSNLKTILEWSPFASKEELMQQFEDIGRHGTKIIIYNLWLNDEGIYELSFDDDEEDIRLRDEANHGQTKLHKKTVELRSHISYCIRYSLRAYASILYLRKFTNFSIVLRGEPVQQFNIVDDLKYSKTVSYKPQVGTIKEVTVETTVGFIKEAPALSVSGFNVYHKNRLIRPFWKVTGDAAVKGNGVVGVLEANFIEPAHDKQDFERSSLYIRLEARLKQMVMDYWKRHCHLLGILPPGVKSLDIQKQGAVKTQKPLPANRHNIDLPTNEEEMHLDQPITRSNRQLGSTGQSDLPVEESIIGLADGSYNGVISDDGLGSKPIDQICEENIELFMRCEEYAKKETELKQTVEELEKELEQAKRKCAQLASHLETKRKQKIMQQQSEKVA

SEQ ID NO: 719 - protein, 631 aa, Brassica napus
MSTNAKTVVAADVVHLDSDDEDVGGGGGGGRGLSLIETPQVPSTTADAAVAPLETLECRSFWKAGESYVTPNVVSQAAPGMLEHARVHPKFLHSNATSHKWAFGAIAELLDNAVDEIQNGATFVKIDKINIAKNNSPALVFQDDGAGMDPNGIRKCMSLGYSSKKSNTTIGQYGNGFKTSTMRLGADAIVFSRSTRSGKATQSVGLLSYTFLRRTGQDDVIVPMIDIDISKERPQPIIYGSSEDWSTNLDILLKWSPFSTKDELLQQFDDIGTHGTKVIIYNLWLNDEGIYELSFDDDDEDIRLRDESVHDGKRVHAKELERRSHISYHLRYSLRAYTSMLYLEKFKNFKIILRGIPVKQFNIADEFRYPEIIKYRPQIATIEQATTEIKVGFIKEAPKLPVCGYNVYHKNRLIRPFWKVTMDGSALGNGVVGVLEANFIEPAHDKQDFERSSLFQRLEARLKKIVYDYWSSHSHVFGYRTPQMPADKSKRIPIPDQPPPVNTFNPFPSPSSQGGPIIREINISNATSVRTVAAPPPHMRNSTGVRNNFQPVQLTPQPAVTDTRNKHVGKSVEEISQENIQLFMKCEEYVKKETEMEQTVRNLEKELEEAKSKCAQLAMLVDAKKKEMQQV

SEQ ID NO: 720 - DNA, 10450 bp, Artificial Sequence
  Synthetic Construct
accaaacactctcgacaggcctcactgcgacgaaccgtttcgatcgcgacccttcagttgtcgtctcccccaaacgaaaccctagcaaattcttccgagtctgctttcgcactaggtaggattctctcgctttggtaagcctattcttcgccgtcgcctaaatttcgagcgcttgatgaaaatgcttagaattaagtagccttgtaattcttaattaatcacgatttgtgctactcctcttttttatgtagaccatgatatatgccgcaaggatgctcgtgatctcggagaactgatgtatgcgtatgctgtaagtcttctcctttcgtgtagcttcaattgattagggtttttcaggtttcagagcaactgggttgggatttgctggtccgctttgtcttctactgttttacacaactaattatggttttgccttccagaacctgcaaaattttggatgcaattctcgtctctttaggtaaacgctattgcttcttctcttattttctaagtcaattgattctgggtaactttaatatcatgcttaaataaagttcgtggttattaattgtcgggatttagagctgagtttagttgtcttgtcgtaagatcttattgtgtgagatattaaataccagattgtttcacagatgcgtctttttagttgtggtaagtctcaggaggtgtgcttaacgtttccattattgacactttttcagtagcaactagcaagtgaagatggaggcaaacgaagaaagtttgaagggaaaaattgaaaagctagagggaaaggaggttattgtggagtcaaaagaggatgagatggatataataatagaagaaaatagggaagcagaacaggaggtaatggaggtgaaagcaagagatggaagaggggagcaaaatgatgtactgatggaagaaaacaacaatcagggtgagcaaaaagatgaggagatgcaagatgcttctagtagatctgaaagttctgacttcaattcagatgaagatgaacaaattctgtcccggcgtgatgatgagttggatcttgaggtatgcatcatggatatctcttgtttacttggcggaggaatagtgtatgtttatctaatatttcttttttcaattattgggcagaaacctttgagcgaggaagaaatagatgagttaatttcagatcttctggcagttgagagcaaggtatttaatctcttgcttttgttcaatggaaatctggataggcctatttaactttcaggtctaaatctcactctttatgattccccattgatctgaaggctgcagaagctcaagaagcactcgaaaaggagtctctttctaaagtagagagtgaagttagggaggaattagcacaagcactccgtggtgatgaggttaatttctttttctctctatcacagctacgggttcctttgctcttttccatttaaacattttaagagtgtgcctttttagttggatgaagctgttgctgctgaaatgatgacttttaaagacgaatgggaggcaactcttgatgagcttgaaacagaaagtgcaaccttgttggtatgtttcgttgttgcttcttctattcccacaaaacttactccaaagggttacttgtcatttaaagtaacttgcgcaactctgcttcccttttcgtttctttcttaaaggagcaacttgatggtgctggaatcgagcttccaaaattgtacgaaatgatagaaagtcaagcccctaatggttgctacactgaagcttggaagcaaagagcccattgggttggtactcaggtgacaaaagaaactgtggaatcattggctaacgctgagaggtttctgcacactcatcggcctgtccgaaagtagggtttttattatctttaacttttagttagttcatttactctgagtctcatggatggtatatctatacatttctggtgtagacgacatggaaaacttttggaggagggagctagtggttttctggagaaaaaactcgctgatggtgctgttaaagaatctctagctggaacatctgagcttgactggtcgtctctaaacaaagtgttttcggaaaaaagggatgagtctgtttcctttggtagtaagcagtgggcttctgtttacttggcaagcactccacaccaagctgcagccatgggattagaatttccaggagtcaatgaggttatattttcaatcatgcctttatattttctaacagtcctgatgctgatgatgatttgcatatgtttacatctgttaattttcgtcgctccaagaaaaaaagcattaaacgtgacatcccctttccttgatcgtttacttgccgttagacatcttaagaaagcatgcgtaattttcccattttgtttatttctgtttgcaagttgctgaatttttggcccgctgttatgccataatcatgacaggaaaacataacctactctgcaatgtaggttttcattaggatcaaaatattaagccaaactctataaataaattcgagcttatacttggttatcattagttgtagttgtagcagttttagatgatgcgaggcactatttacaaccttgggatgcaatcaggcttttattatcctagatcacgccatcctacagcttgagaatcttaattatactcctggcagtctggagtgattatcacagtatttattatttaattttgttgttaggtggaggaaattgaagagattgatgcaagcttagcagacccatttttagctgatgcaattgacaacgaaagagaacttgcccttactgaagaacaaaagacaaattatataagggtattacttttgacttaacttcttagatttctgttaccaagtcttcgaattttgaaagtattaccttttttggctgttagaacaaaataaaattatctaaaggtattagtgtttcacttaacttcttagatttctggaattaagcgttctacttttgaaattataaccttttctggctgctccttatgttcttgcttttgcggagttggcagtaaatctatatatatgaaataccatttaagactactcacaactcctgccttaccctttatgagcttcagtatgacattaaatcatctacaggtcaaagaagaggatgatataacttgtgatcgtgtacttcaacttcgtttgaaacggaaaagacgcaagaaaagatctaaacaggtctgttatgcatattctttcagttccttatcgtaactttgcatatatctgattgaaggcgtcttggtgttacaagtagcatagtcacgactatcttctttagtggatatcattcttaatgagcatggttttggagaatttagtcactgataggttgtgttttcctataattttcttagttaatattaatggtgattaaagtaccagaagatatattactgagaaatatacatttttagtataaagatgacaatttgcctgtaagtttagccctcacatcttgttgctcaattgtcaagtgatggttctttcttgtgttaaagcggcatttggggcttgtggtgccaggggtttcgttggtttgaaggaataatctttagctcacgtatcagtcttcatttggttttatatcaggttattaggtgtgcggcagagaatatggatgatgattctgtgtatttggatgggaataatactaccccaaattttgccaaagatcaagtgaaaagtccggagactagcactcaagttcataatagtgaagtcaacatagaggaaaacgggaatttttctaattcagatgtagataagatgacccccagcacacatattaatgtagatgccaagagagatgattcacagaatccagcaaacaattttaggtgtactgcctgtaataaagtagctgtggaagtgcatagtcatccccttttagaagtaatagtttgcatggattgcaaacgttcaattgaagatagagtttctaaggtatgcttttttcttcttccaattatatgtgacttactttgtttttgcatttgggtcagaatttagttagaaattagatttctttaatgtggtgaatagcatatcacatggatggcttcttttctgaaagggattgaaaggtaccaatcgtgttcatggactgctttttagccacccttaattggttagcttcaatatgattgctggtttggatattcaatgtgcgcaaattctgggggactggcacatggaaagattttctgttgccgtagtagattcagctgctttcctttgagtaacggacttcttttggtgcatgttacttttgttatttagagatcacatagaaatgttgccgtaatctaaagaatattgctatatctgtctctttctaatcaaaacgttgacttttgtctctttctaatcaaaacgtgacttttgcctacaggttgatgactctttggaacgtcattgtgaatggtgtggtcatattgctgacttaatagattgtaggacatgcgaaaaacttttctgtgcatcatgtataaagaggaatattggtgaagaatacatgtctgaagctcaatcctctggttgggattgttgttgttgctctccaattcccttgcaaagattgacactggaactggagaaagctatgagagataaaaagtcaatagaattgagctctgattcgagttctgattccagctctgataacaattctgttgatacagatgctgatgtcaatgtaacaatcaggtattatcatatactcatctaacaaaaattgaaaatttcagcatgttgccaactaatttggtatttttcttacgtgcatggtttttttcttttagctcaaagaagaaatcgaaaaagaaaattcggcggataatcgatgacgctgaactagggaaagatacgagaacaaagattgcaatcgaaaaggtgtttaattttttggcagttgcttttgttaaacttgtatataaacttcaaaaaaaaaattatttaagtattgctcgttgtacattgggttctttctttttgtaggcacgacaggagcgccttaggtccttgcagttttctgccagatacaaaacaattagctctatgggagacgtgaaatctattccagaaggtgcggaagttgaggttcttggtgatgctcacagtggttacatagtgaatgtggttagggagattggtgaagaagctgtgagggttcctcgtagcatatctgccaaactaaaagtccatcaggttagcatttacatatgtgtatccctatcatcataatatacttccatctcgcttgtcacctataccattgggtattaaagatagccatctcgactagaaatgcctattatggaaatagcttttgctgtaagtttggagttttttttttcaggtaacagggataagatttatgtgggaaaatattattcagtctatcagcagagtcaagtctggtgataaaggtcttggttgcattctagcacatacaatgggcctgggcaaaacttttcaggtgcttaattcttttcatgcacgaggctgtttggatatatcgtattatcgtccgattctattagtgcatactactaatggttaatcgttatttgttaattactggctctttatgtcttctctcacttaaacctattcaggttatagcattcctgtacaccgcaatgagatgtgttgatttagggttgaaaactgctcttattgtgactcctgtaaatgtgttgcacaattggcgaagtgagtttgagaagtggatgccttcagaagtgaaaccgcttcgcatttttatgcttggagatgtttcaaggtataaattcttctatgaaagaaacttttggtacttgacaattcagattcttatgttttctaatctagtctaggttttagatatttaaaataggggctgggtagtctatagtggtgtgccataacttatggcccataagactgctgaatgttacttatactaaagctatctgaagatcttttccctaatcaaagaatatagatgcaagccctctcgtccaaacacaagatctcagctgtcttaacttcctactaaactgacctattggcccatatatcaaacacttattttggcctatgtaagttgtatttttggtgacagtttctctatccacttcctgctcgaatgttttttttgaagggagagaagatttgatttgctaacaaagtggcgaaagaagggtggagtctttttgatgggatatacaaattttagaaacctgtctcttgggaggggggtgaaggacttaaatgcggccagagggatctgtaatgccttgagggtgagactataatgtcacttgcaaaattttattgatttctatcctgttaatattctaggtcattttaggaaagcgtttgacgtgctgtttatgtttacacattactttttgaaggttaatatttctgctatttaaaggccatatctgtatcatagattttgttgttttcatgttttctcttgtttatgatttcccttgtgcatatacctctgcttgcaatattttattcttgcaattcctaaacctatgtggctgcaggatggacctgatatacttgtttgcgacgaggctcacatcattaagaacaccaaggctgacacaacgcaagcattgaagcaagttaaatgccagagaagaattgccttaactggctcaccccttcaaaacaatctcatggagtattattgtgtaagttactgagggaactatataaaattgtgacctaattttttcttatctccagtatctttagctatgtctgtactgcaacagatggttgattttgtgagagaaggattcttgggaagtagccctgagtttagaaaccggcaagtctttcataccagtttttttttttttatctgtctattatgatgttatgtttctagagttttaactgtggttctccatacctgcagcttccaaaatccaatagaaaacggacagcatatgaattcaactgcggaggatgtaaaaattatgaaccagaggtcacacattctgtatgagcaattgaaaggttttgtgcaaagaatggatatgaatgtggtgaaaaaggatctgccacctaaaacagtcttcgtaatatctgtcaagctatctcccttgcaacggatattgtatcagagatttcttgagctttatgggttcagcgatggaagaacagatgaaaggatgagaaaaaacttttttgctgcttaccaggtcttggctcaggtataaatgtgataaaggccttgctatacttaaattaacaacttatttgagaaaaaaatgttaagaataataatgttaataactgatttatctggtattcgttttcatattctgaactctctctttggtattacgtctcccagattttgaatcatccagggattccgcaattaagaagtgaagatagcaagaatggtcgtcgtggtagcattgttgatattccagatgactgttcaagtgatgaaaatatagactacaacatggttacaggaggtaactcttaattggcactactcacatattttaagattttattaaactagtatgaagaatagaaggaacagaaaaacattggacttgttccatggttaagatagatgtcttttggttttgaattcaaggaatactaggtgcagtagatattatacctttttggtaccgttccagtttgaataagattgccaatagaggattagttttattggtctaagactttcttaccaagaataatctatgacatgcaatagttaagggaccttcgattcagcaatgttatgttttaagcttcatcatattctgtggagctttcaggagtgatctttctttgtttgcatctatgcaagttcaataatagtgagaaaagtattaataatctgtgtcattgttgttttggatattgacagagaaacagagaactatgaatgatctgcaggataaagttgatggatacctccagaaggtaactatagtttactcagcctgagtgaattagtaactactgcctataactttaaagtaaacagcagcgtaattgtgcacccatgctctgattctaaccctgtctttgtgccaggattggtgggtcgacctacttcaaaaaaataattataaggtgtcggacttcagtggcaaaatgattctgctattggatattttatctatgagtgctgatgtgggggataaggcgcttgtgtttagccagagtatcccgacattggatctcatagaactttatctttcaagagtacctcggcatgggaaacaaggaaagttctggaaaaaggggaaagactggtataggttggtatcttattctcttatattcgcgtgaatgttttttgaacaattatgaagactctaacttcccttgatggatgcagaattgatggaaaaactgaaagctcagaacgccagaagttggttgataggtttaatgagcctgacaacaaaagagtgaaatgtacactaatttcaaccagagcgggatcccttggaattaacctttatgctgctaaccgtgtgatcatcgtcgatggttcatggaatccaacctatgatcttcaagctatatttcgagcttggaggtattttctagactatggaattaaaatttgtcaatatagcattacaaacggtggcttattatacgtggacttattggttgcaggtatggccaaaagaagcccgtatttgcgtacagattgatggcacgtgggactattgaagaaaaaatatataaacgtcaggtattgaaaggcataaaacaatgttgaattttgctgtttctttccttcaaagagacattcatgaatcagatctgttaatatgattaggtaaccaaggaagggctagctgcgagagtagtggatagacaacaagtgcacaggactatctccaaagaagagatgttacatctttttgaatttgacgatgatgatgaaaaatctgaagccgtaactgagataagcaagcaaaatgaagcgggacatagcaatctggtggagcaagcaatcttgtggacaaagaaggccactttatctcgtgttggtggcgacaaattgatggagaacttactacagagacacggccccaagtaagtttcacaagcgtaaccatattcacatcagtacctaaaatctttggttttttatgctacttgctttgtaacactatatgtcctttttcactagctggatttccagtttccatgagcacgagacattgctacaagagaatgaagaagaaagactgacaaaggaagaaaaagacatggcctgggaagtttataggagagcacttgagtgggaggaagttcaacgggtcccattcagtgaatctccagtggttccaaaaccttctccttccacacaaacagagcccttgccccagccaaaggggttcaacaggagtcgttttgtaaaccgcaactgcactagaatcgcgcaccagcttacactcataagccaaggattaaaagtcggcagcagcacagtctgtggggagtgtgggcgcgtcataaggtgggaagatgttatacccgcatccaaactttcagcggtaattgtaaacggttcgaaatcgataagcttggatcctctagaccctttgcctgctgccgctgccgctgactacaaagaccatgacggtgattataaagatcatgatatcgattacaaggatgacgatgacaagggactagacttggctgccgctgccgctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgagtgaatagaacattgcaaaaatgttgagttcatttttccttcttttaaattatgagactgaaccaaaatttatgggaatagtaacatttgaaactcccttcagattagatgtgagttataatgtaactcagggcgtttggtaggagcatgttgaaatttgtaatgacacctgtttcgagattcaaa

SEQ ID NO: 721 - DNA, 738 bp, Artificial Sequence
  Synthetic Construct
accaaacactctcgacaggcctcactgcgacgaaccgtttcgatcgcgacccttcagttgtcgtctcccccaaacgaaaccctagcaaattcttccgagtctgctttcgcactaggtaggattctctcgctttggtaagcctattcttcgccgtcgcctaaatttcgagcgcttgatgaaaatgcttagaattaagtagccttgtaattcttaattaatcacgatttgtgctactcctcttttttatgtagaccatgatatatgccgcaaggatgctcgtgatctcggagaactgatgtatgcgtatgctgtaagtcttctcctttcgtgtagcttcaattgattagggtttttcaggtttcagagcaactgggttgggatttgctggtccgctttgtcttctactgttttacacaactaattatggttttgccttccagaacctgcaaaattttggatgcaattctcgtctctttaggtaaacgctattgcttcttctcttattttctaagtcaattgattctgggtaactttaatatcatgcttaaataaagttcgtggttattaattgtcgggatttagagctgagtttagttgtcttgtcgtaagatcttattgtgtgagatattaaataccagattgtttcacagatgcgtctttttagttgtggtaagtctcaggaggtgtgcttaacgtttccattattgacactttttcagtagcaactagcaagtgaag

SEQ ID NO: 722 - DNA, 8867 bp, Artificial Sequence
  Synthetic Construct
atggaggcaaacgaagaaagtttgaagggaaaaattgaaaagctagagggaaaggaggttattgtggagtcaaaagaggatgagatggatataataatagaagaaaatagggaagcagaacaggaggtaatggaggtgaaagcaagagatggaagaggggagcaaaatgatgtactgatggaagaaaacaacaatcagggtgagcaaaaagatgaggagatgcaagatgcttctagtagatctgaaagttctgacttcaattcagatgaagatgaacaaattctgtcccggcgtgatgatgagttggatcttgaggtatgcatcatggatatctcttgtttacttggcggaggaatagtgtatgtttatctaatatttcttttttcaattattgggcagaaacctttgagcgaggaagaaatagatgagttaatttcagatcttctggcagttgagagcaaggtatttaatctcttgcttttgttcaatggaaatctggataggcctatttaactttcaggtctaaatctcactctttatgattccccattgatctgaaggctgcagaagctcaagaagcactcgaaaaggagtctctttctaaagtagagagtgaagttagggaggaattagcacaagcactccgtggtgatgaggttaatttctttttctctctatcacagctacgggttcctttgctcttttccatttaaacattttaagagtgtgcctttttagttggatgaagctgttgctgctgaaatgatgacttttaaagacgaatgggaggcaactcttgatgagcttgaaacagaaagtgcaaccttgttggtatgtttcgttgttgcttcttctattcccacaaaacttactccaaagggttacttgtcatttaaagtaacttgcgcaactctgcttcccttttcgtttctttcttaaaggagcaacttgatggtgctggaatcgagcttccaaaattgtacgaaatgatagaaagtcaagcccctaatggttgctacactgaagcttggaagcaaagagcccattgggttggtactcaggtgacaaaagaaactgtggaatcattggctaacgctgagaggtttctgcacactcatcggcctgtccgaaagtagggtttttattatctttaacttttagttagttcatttactctgagtctcatggatggtatatctatacatttctggtgtagacgacatggaaaacttttggaggagggagctagtggttttctggagaaaaaactcgctgatggtgctgttaaagaatctctagctggaacatctgagcttgactggtcgtctctaaacaaagtgttttcggaaaaaagggatgagtctgtttcctttggtagtaagcagtgggcttctgtttacttggcaagcactccacaccaagctgcagccatgggattagaatttccaggagtcaatgaggttatattttcaatcatgcctttatattttctaacagtcctgatgctgatgatgatttgcatatgtttacatctgttaattttcgtcgctccaagaaaaaaagcattaaacgtgacatcccctttccttgatcgtttacttgccgttagacatcttaagaaagcatgcgtaattttcccattttgtttatttctgtttgcaagttgctgaatttttggcccgctgttatgccataatcatgacaggaaaacataacctactctgcaatgtaggttttcattaggatcaaaatattaagccaaactctataaataaattcgagcttatacttggttatcattagttgtagttgtagcagttttagatgatgcgaggcactatttacaaccttgggatgcaatcaggcttttattatcctagatcacgccatcctacagcttgagaatcttaattatactcctggcagtctggagtgattatcacagtatttattatttaattttgttgttaggtggaggaaattgaagagattgatgcaagcttagcagacccatttttagctgatgcaattgacaacgaaagagaacttgcccttactgaagaacaaaagacaaattatataagggtattacttttgacttaacttcttagatttctgttaccaagtcttcgaattttgaaagtattaccttttttggctgttagaacaaaataaaattatctaaaggtattagtgtttcacttaacttcttagatttctggaattaagcgttctacttttgaaattataaccttttctggctgctccttatgttcttgcttttgcggagttggcagtaaatctatatatatgaaataccatttaagactactcacaactcctgccttaccctttatgagcttcagtatgacattaaatcatctacaggtcaaagaagaggatgatataacttgtgatcgtgtacttcaacttcgtttgaaacggaaaagacgcaagaaaagatctaaacaggtctgttatgcatattctttcagttccttatcgtaactttgcatatatctgattgaaggcgtcttggtgttacaagtagcatagtcacgactatcttctttagtggatatcattcttaatgagcatggttttggagaatttagtcactgataggttgtgttttcctataattttcttagttaatattaatggtgattaaagtaccagaagatatattactgagaaatatacatttttagtataaagatgacaatttgcctgtaagtttagccctcacatcttgttgctcaattgtcaagtgatggttctttcttgtgttaaagcggcatttggggcttgtggtgccaggggtttcgttggtttgaaggaataatctttagctcacgtatcagtcttcatttggttttatatcaggttattaggtgtgcggcagagaatatggatgatgattctgtgtatttggatgggaataatactaccccaaattttgccaaagatcaagtgaaaagtccggagactagcactcaagttcataatagtgaagtcaacatagaggaaaacgggaatttttctaattcagatgtagataagatgacccccagcacacatattaatgtagatgccaagagagatgattcacagaatccagcaaacaattttaggtgtactgcctgtaataaagtagctgtggaagtgcatagtcatccccttttagaagtaatagtttgcatggattgcaaacgttcaattgaagatagagtttctaaggtatgcttttttcttcttccaattatatgtgacttactttgtttttgcatttgggtcagaatttagttagaaattagatttctttaatgtggtgaatagcatatcacatggatggcttcttttctgaaagggattgaaaggtaccaatcgtgttcatggactgctttttagccacccttaattggttagcttcaatatgattgctggtttggatattcaatgtgcgcaaattctgggggactggcacatggaaagattttctgttgccgtagtagattcagctgctttcctttgagtaacggacttcttttggtgcatgttacttttgttatttagagatcacatagaaatgttgccgtaatctaaagaatattgctatatctgtctctttctaatcaaaacgttgacttttgtctctttctaatcaaaacgtgacttttgcctacaggttgatgactctttggaacgtcattgtgaatggtgtggtcatattgctgacttaatagattgtaggacatgcgaaaaacttttctgtgcatcatgtataaagaggaatattggtgaagaatacatgtctgaagctcaatcctctggttgggattgttgttgttgctctccaattcccttgcaaagattgacactggaactggagaaagctatgagagataaaaagtcaatagaattgagctctgattcgagttctgattccagctctgataacaattctgttgatacagatgctgatgtcaatgtaacaatcaggtattatcatatactcatctaacaaaaattgaaaatttcagcatgttgccaactaatttggtatttttcttacgtgcatggtttttttcttttagctcaaagaagaaatcgaaaaagaaaattcggcggataatcgatgacgctgaactagggaaagatacgagaacaaagattgcaatcgaaaaggtgtttaattttttggcagttgcttttgttaaacttgtatataaacttcaaaaaaaaaattatttaagtattgctcgttgtacattgggttctttctttttgtaggcacgacaggagcgccttaggtccttgcagttttctgccagatacaaaacaattagctctatgggagacgtgaaatctattccagaaggtgcggaagttgaggttcttggtgatgctcacagtggttacatagtgaatgtggttagggagattggtgaagaagctgtgagggttcctcgtagcatatctgccaaactaaaagtccatcaggttagcatttacatatgtgtatccctatcatcataatatacttccatctcgcttgtcacctataccattgggtattaaagatagccatctcgactagaaatgcctattatggaaatagcttttgctgtaagtttggagttttttttttcaggtaacagggataagatttatgtgggaaaatattattcagtctatcagcagagtcaagtctggtgataaaggtcttggttgcattctagcacatacaatgggcctgggcaaaacttttcaggtgcttaattcttttcatgcacgaggctgtttggatatatcgtattatcgtccgattctattagtgcatactactaatggttaatcgttatttgttaattactggctctttatgtcttctctcacttaaacctattcaggttatagcattcctgtacaccgcaatgagatgtgttgatttagggttgaaaactgctcttattgtgactcctgtaaatgtgttgcacaattggcgaagtgagtttgagaagtggatgccttcagaagtgaaaccgcttcgcatttttatgcttggagatgtttcaaggtataaattcttctatgaaagaaacttttggtacttgacaattcagattcttatgttttctaatctagtctaggttttagatatttaaaataggggctgggtagtctatagtggtgtgccataacttatggcccataagactgctgaatgttacttatactaaagctatctgaagatcttttccctaatcaaagaatatagatgcaagccctctcgtccaaacacaagatctcagctgtcttaacttcctactaaactgacctattggcccatatatcaaacacttattttggcctatgtaagttgtatttttggtgacagtttctctatccacttcctgctcgaatgttttttttgaagggagagaagatttgatttgctaacaaagtggcgaaagaagggtggagtctttttgatgggatatacaaattttagaaacctgtctcttgggaggggggtgaaggacttaaatgcggccagagggatctgtaatgccttgagggtgagactataatgtcacttgcaaaattttattgatttctatcctgttaatattctaggtcattttaggaaagcgtttgacgtgctgtttatgtttacacattactttttgaaggttaatatttctgctatttaaaggccatatctgtatcatagattttgttgttttcatgttttctcttgtttatgatttcccttgtgcatatacctctgcttgcaatattttattcttgcaattcctaaacctatgtggctgcaggatggacctgatatacttgtttgcgacgaggctcacatcattaagaacaccaaggctgacacaacgcaagcattgaagcaagttaaatgccagagaagaattgccttaactggctcaccccttcaaaacaatctcatggagtattattgtgtaagttactgagggaactatataaaattgtgacctaattttttcttatctccagtatctttagctatgtctgtactgcaacagatggttgattttgtgagagaaggattcttgggaagtagccctgagtttagaaaccggcaagtctttcataccagtttttttttttttatctgtctattatgatgttatgtttctagagttttaactgtggttctccatacctgcagcttccaaaatccaatagaaaacggacagcatatgaattcaactgcggaggatgtaaaaattatgaaccagaggtcacacattctgtatgagcaattgaaaggttttgtgcaaagaatggatatgaatgtggtgaaaaaggatctgccacctaaaacagtcttcgtaatatctgtcaagctatctcccttgcaacggatattgtatcagagatttcttgagctttatgggttcagcgatggaagaacagatgaaaggatgagaaaaaacttttttgctgcttaccaggtcttggctcaggtataaatgtgataaaggccttgctatacttaaattaacaacttatttgagaaaaaaatgttaagaataataatgttaataactgatttatctggtattcgttttcatattctgaactctctctttggtattacgtctcccagattttgaatcatccagggattccgcaattaagaagtgaagatagcaagaatggtcgtcgtggtagcattgttgatattccagatgactgttcaagtgatgaaaatatagactacaacatggttacaggaggtaactcttaattggcactactcacatattttaagattttattaaactagtatgaagaatagaaggaacagaaaaacattggacttgttccatggttaagatagatgtcttttggttttgaattcaaggaatactaggtgcagtagatattatacctttttggtaccgttccagtttgaataagattgccaatagaggattagttttattggtctaagactttcttaccaagaataatctatgacatgcaatagttaagggaccttcgattcagcaatgttatgttttaagcttcatcatattctgtggagctttcaggagtgatctttctttgtttgcatctatgcaagttcaataatagtgagaaaagtattaataatctgtgtcattgttgttttggatattgacagagaaacagagaactatgaatgatctgcaggataaagttgatggatacctccagaaggtaactatagtttactcagcctgagtgaattagtaactactgcctataactttaaagtaaacagcagcgtaattgtgcacccatgctctgattctaaccctgtctttgtgccaggattggtgggtcgacctacttcaaaaaaataattataaggtgtcggacttcagtggcaaaatgattctgctattggatattttatctatgagtgctgatgtgggggataaggcgcttgtgtttagccagagtatcccgacattggatctcatagaactttatctttcaagagtacctcggcatgggaaacaaggaaagttctggaaaaaggggaaagactggtataggttggtatcttattctcttatattcgcgtgaatgttttttgaacaattatgaagactctaacttcccttgatggatgcagaattgatggaaaaactgaaagctcagaacgccagaagttggttgataggtttaatgagcctgacaacaaaagagtgaaatgtacactaatttcaaccagagcgggatcccttggaattaacctttatgctgctaaccgtgtgatcatcgtcgatggttcatggaatccaacctatgatcttcaagctatatttcgagcttggaggtattttctagactatggaattaaaatttgtcaatatagcattacaaacggtggcttattatacgtggacttattggttgcaggtatggccaaaagaagcccgtatttgcgtacagattgatggcacgtgggactattgaagaaaaaatatataaacgtcaggtattgaaaggcataaaacaatgttgaattttgctgtttctttccttcaaagagacattcatgaatcagatctgttaatatgattaggtaaccaaggaagggctagctgcgagagtagtggatagacaacaagtgcacaggactatctccaaagaagagatgttacatctttttgaatttgacgatgatgatgaaaaatctgaagccgtaactgagataagcaagcaaaatgaagcgggacatagcaatctggtggagcaagcaatcttgtggacaaagaaggccactttatctcgtgttggtggcgacaaattgatggagaacttactacagagacacggccccaagtaagtttcacaagcgtaaccatattcacatcagtacctaaaatctttggttttttatgctacttgctttgtaacactatatgtcctttttcactagctggatttccagtttccatgagcacgagacattgctacaagagaatgaagaagaaagactgacaaaggaagaaaaagacatggcctgggaagtttataggagagcacttgagtgggaggaagttcaacgggtcccattcagtgaatctccagtggttccaaaaccttctccttccacacaaacagagcccttgccccagccaaaggggttcaacaggagtcgttttgtaaaccgcaactgcactagaatcgcgcaccagcttacactcataagccaaggattaaaagtcggcagcagcacagtctgtggggagtgtgggcgcgtcataaggtgggaagatgttatacccgcatccaaactttcagcggtaattgtaaac

SEQ ID NO: 723 - DNA, 57 bp, Artificial Sequence
  Synthetic Construct
ggttcgaaatcgataagcttggatcctctagaccctttgcctgctgccgctgccgct

SEQ ID NO: 724 - DNA, 66 bp, Artificial Sequence
  Synthetic Construct
gactacaaagaccatgacggtgattataaagatcatgatatcgattacaaggatgacgatgacaag

SEQ ID NO: 725 - DNA, 27 bp, Artificial Sequence
  Synthetic Construct
ggactagacttggctgccgctgccgct

SEQ ID NO: 726 - DNA, 513 bp, Artificial Sequence
  Synthetic Construct
ctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgagtga

SEQ ID NO: 727 - DNA, 182 bp, Artificial Sequence
  Synthetic Construct
atagaacattgcaaaaatgttgagttcatttttccttcttttaaattatgagactgaaccaaaatttatgggaatagtaacatttgaaactcccttcagattagatgtgagttataatgtaactcagggcgtttggtaggagcatgttgaaatttgtaatgacacctgtttcgagattcaaa

SEQ ID NO: 728 - protein, 1698 aa, Artificial Sequence
  Synthetic Construct
MEANEESLKGKIEKLEGKEVIVESKEDEMDIIIEENREAEQEVMEVKARDGRGEQNDVLMEENNNQGEQKDEEMQDASSRSESSDFNSDEDEQILSRRDDELDLEKPLSEEEIDELISDLLAVESKAAEAQEALEKESLSKVESEVREELAQALRGDELDEAVAAEMMTFKDEWEATLDELETESATLLEQLDGAGIELPKLYEMIESQAPNGCYTEAWKQRAHWVGTQVTKETVESLANAERFLHTHRPVRKRHGKLLEEGASGFLEKKLADGAVKESLAGTSELDWSSLNKVFSEKRDESVSFGSKQWASVYLASTPHQAAAMGLEFPGVNEVEEIEEIDASLADPFLADAIDNERELALTEEQKTNYIRVKEEDDITCDRVLQLRLKRKRRKKRSKQVIRCAAENMDDDSVYLDGNNTTPNFAKDQVKSPETSTQVHNSEVNIEENGNFSNSDVDKMTPSTHINVDAKRDDSQNPANNFRCTACNKVAVEVHSHPLLEVIVCMDCKRSIEDRVSKVDDSLERHCEWCGHIADLIDCRTCEKLFCASCIKRNIGEEYMSEAQSSGWDCCCCSPIPLQRLTLELEKAMRDKKSIELSSDSSSDSSSDNNSVDTDADVNVTISSKKKSKKKIRRIIDDAELGKDTRTKIAIEKARQERLRSLQFSARYKTISSMGDVKSIPEGAEVEVLGDAHSGYIVNVVREIGEEAVRVPRSISAKLKVHQVTGIRFMWENIIQSISRVKSGDKGLGCILAHTMGLGKTFQVIAFLYTAMRCVDLGLKTALIVTPVNVLHNWRSEFEKWMPSEVKPLRIFMLGDVSRERRFDLLTKWRKKGGVFLMGYTNFRNLSLGRGVKDLNAARGICNALRDGPDILVCDEAHIIKNTKADTTQALKQVKCQRRIALTGSPLQNNLMEYYCMVDFVREGFLGSSPEFRNRFQNPIENGQHMNSTAEDVKIMNQRSHILYEQLKGFVQRMDMNVVKKDLPPKTVFVISVKLSPLQRILYQRFLELYGFSDGRTDERMRKNFFAAYQVLAQILNHPGIPQLRSEDSKNGRRGSIVDIPDDCSSDENIDYNMVTGEKQRTMNDLQDKVDGYLQKDWWVDLLQKNNYKVSDFSGKMILLLDILSMSADVGDKALVFSQSIPTLDLIELYLSRVPRHGKQGKFWKKGKDWYRIDGKTESSERQKLVDRFNEPDNKRVKCTLISTRAGSLGINLYAANRVIIVDGSWNPTYDLQAIFRAWRYGQKKPVFAYRLMARGTIEEKIYKRQVTKEGLAARVVDRQQVHRTISKEEMLHLFEFDDDDEKSEAVTEISKQNEAGHSNLVEQAILWTKKATLSRVGGDKLMENLLQRHGPNWISSFHEHETLLQENEEERLTKEEKDMAWEVYRRALEWEEVQRVPFSESPVVPKPSPSTQTEPLPQPKGFNRSRFVNRNCTRIAHQLTLISQGLKVGSSTVCGECGRVIRWEDVIPASKLSAVIVNGSKSISLDPLDPLPAAAAADYKDHDGDYKDHDIDYKDDDDKGLDLAAAAALEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEPYKCPECGKSFSRSDKLTEHQRTHTGLE

SEQ ID NO: 729 - protein, 1479 aa, Artificial Sequence; identical to SEQ ID NO: 681
  Synthetic Construct

SEQ ID NO: 730 - protein, 19 aa, Artificial Sequence
  Synthetic Construct
GSKSISLDPLDPLPAAAAA

SEQ ID NO: 731 - protein, 22 aa, Artificial Sequence
  Synthetic Construct
DYKDHDGDYKDHDIDYKDDDDK

SEQ ID NO: 732 - protein, 9 aa, Artificial Sequence
  Synthetic Construct
GLDLAAAAA

SEQ ID NO: 733 - protein, 169 aa, Artificial Sequence
  Synthetic Construct
LEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEPYKCPECGKSFSRSDKLTEHQRTHTGLE

SEQ ID NO: 734 - DNA, 10003 bp, Artificial Sequence
  Synthetic Construct
cacaagcatgagtttttccttccggtaatcgtaaaatcaaaaatcgctcgctcgagaaacgccggtgctagaagaggaaagtaccgtacataatcctgcgaacccaattctcgtcttcttcaaactcagttttccgaaaccccaaacaccgcgaggattgcatggcctgaagaaccacttaatcgagaattgtgctggaattctcaaattttccctcgcgtttttctttcacactctcggaatcggaaatttccaccaagctccgtcaagcgatagattctgacaattacacactttcgcgcaggtatgcttccttccctgttttaggttggtgttaatctatcggtgaatcgaaggttttgggcctcgggctttgcgttttaggtttttcagagaatcttatctacttggggatggatcttaggcgtttgttagatgtaactcattagttttgcatataggaattttgatttgaaagttaggtcgccggatttgtagacattttgtttgatggtcttcttcggtgctcacattctttgtttttaagtgcttgatttggttgctaaggtcctttccgttgcgtgctctcagtgaatatgaagaaagatgaaaagattggtttgacggggagaaccatttacaccagatccctagcagcttcaattcctgcctcagttgaacaagaaacccctggtttgaggaggtcaagccgggggacaccatctacgaaggtaataactccagcttctgctactagaaagtcagagagactggctccctcacctgcttcagtttcaaaaaagtccggtggaatcgtcaagaattccacaccaagttctttgcgaaggtccaatagggggaagactgaagtatccttgcagagttccaaaggatcagataattctatcaggaaaggagatacttcaccggatattgagcagagaaaggatagtgttgaagagtcgacagataagatcaagcctataatgtcagcccgaagttacagggcattgtttagagggaagctcaaggaatctgaggcattagttgatgcttccccaaatgaagaggaactagtagttgttggttgttctcgccgcatacctgcaggcaatgatgatgttcaaggtaaaacagattgtccaccacctgcagatgcaggatcaaaaaggctgccagttgacgaaactagtttggacaagggcactgattttcctttgaaatcagttacggagaccgagaagatagtgcttgatgcatcccccatagttgaaactggggatgacagtgttataggttcaccatctgagaatttagagacacaaaagcttcaagatggtaagacagattgttcaccacctgcaaatgcagaatcgaaaacgctgccagttggtgaaactagtttagaaaaagaatatccacaaaagtttcaagatgataacacagattgtctaccacctgcaaatgcagaatcaaaaaggctgccagttggcgaaactagtttagaaaaggacactgattttcctttgaaatcaactacggagactggaaagatggttctttatgcatcccccatagttgaaactagggatgacagcgttatatgttcaccatctacaaatttagaaacccaaaagcttcttgtcagtaaaactggcttagaaaccgacatagttttgcctttgaaaagaaaaagagacactgcagaaattgagctggatgcatgtgctacagttgcaaatggagatgatcacgttatgagttctgatggggtcattccatctccatctgggtgcaaaaatgataatcgacctgaaatgtgcaacacgtgtaaaaaacggcaaaagtaagagtttttttagtgttgtctgtctattgaaacgatctgccaatgttgaatgttgggcagatgggtttgattcttaggatatatgttctgtattgtaatgagttgttcaaaattttgaagggtcaacggtgattgtcaaaataggagtgtttgctcctgcattgtccagccagttgaagaatctgataacgtgacacaggttggtttctaattactttcggagacccgttaatcagtggactcttaaatagttagatactagatttacttatccttttacttgtaatctgcaattctattttgcatttgattaggatatgaaagaaactggaccagttacgagcagagaatatgaggagaacgggcaaatacaacatggtaaatcaagtgatcccaaattctattcttcggtgtacccagagtattgggttcctgtgcagctatcagatgtacagctggagcaatactgtcagactctcttctccaaatccttatctctttcttcactttcgaagattgatcttggagctctagaagaaactctcaattctgtaagaaaagtaagttacttgattttaaaaacacttattcttcaatgcacttgtgagttaagtacccagttattactggtgataagataaagaaagcaatagaaaaattgataaggtgttcaccgcattgcagccaaaaaaacaattctgtgttccatgctttcaagaggttgtcacataggtgttatgcctttctgtttgatgtttggtagagcaaaggttttgggtctatttgttttatgcttttttgaaacacatagaacctggcaaacttgacagttttggggttgcttagatatacgactattgtcggtcagcatcacattttctcaaggcctctttctgcatgttaatgtgtgaatatattaaaatcttctttatgtgtttgcaacttgttgacagacctgtgaccatccatacgttatggatgcatctttgaaacaactgctcaccaagaatctggagttgcatgaaatcctggatgtagaaattaaagcgagcgggaaacttcacctccttgataaaatgcttactcatataaaaaagaatggtttaaaagcagttgtcttctaccaggtgcattttctattacttgcgaatgtgaatagctctatgtttgtcatgaatacgtcactttgtgcattctcaatatatgtgcattttctttttgacaatggaattctgtcttgtattgaaatttgagtgggatgaaagtatgctttttatcgtgcaattatgaagtgtaagttagccttcagcagtcagctagcattatgagatatgctgaactaaaatgtttcttttctcttctttctttttcgttatatgtgcctcatgtatgtttgaattacagtttttattttcagcaggcaacacaaacccctgaagggcttctgcttggtaatattctcgaagattttgtgggtcaaagatttggtccaaaatcttatgagcatgggatatattcctcaaagaagaactccgctataaacaatttcaacaaggagagtcaatgctgtgttctgctgttggaaacacgtgcctgcagtcaaaccattaaactcttgcgagctgatgcgtttattctttttggaagcagcttgaatccatcgcatgatgttaagcacgtagagaagataaaaatcgagtcatgttctgaaagaactaagatattccgattgtactcagtatgtacagttgaagaaaaagccctgattctggctaggcaaaataagcggcaaaataaagctgtagagaacctaaaccgctctctcacgcacgcactgctcatgtggggggcgtcatacttatttgataaactggatcattttcacagcagtgaaactccagattcaggagtttcatttgaacaatctattatggacggcgtgattcatgaattctcgtccatactttcttccaaaggtggagaagaaaatgaagtcaagctgtgtctacttttggaggccaagcatgctcagggaacttacagcagtgattctactctatttggtgaagaccatattaagttgtcagatgaagagagtccaaatatattttggtcaaagctgttggggggaaaaaatcctatgtggaaatacccttcagatactccccaaaggaatcgaaaacgagttcagtattttgagggttctgaagcgagtcccaaaactggcgatggtggaaatgcaaagaagcgaaagaaggcttctgatgatgtcactgatccccgggtcactgatccgccagtagatgatgatgaaagaaaggcctctgggaaggatcacatgggtaaaatagtttaatttctgctccgatacctctagtgttcattgattatgcaactactttgctgactatctttcctacaggggctttggagtcaccaaaagtcataacactccagtcatcatgtaaatcttctggtacagatggtacattggatggaaatgatgcttttggcttgtattctatgggcagccatatctctggaatcccagaggatatgttagctagtcaagattgggggaaaataccggatgaatcacagaggaggctccacactgttttaaagccgaagatggcaaaactttgccaagttttgcatctttcagtaagtggcctttttcacctccacaacttattttagccttgcatatgcttatatatagctgattgcaactgtagttgttacctgatttcctgttacagccaaatgtgagagttttattcttcaactatatccatccgtttaagcatattttatttcttatatctggcttcgttaccaatgcactgttaaaatgagcaactgctgcacaaaacagtaggtagttatgtgcctcatgtcattcattgtttattgaagcaaagaaatttctgtctactttacatgatccatctgtgggagtatataactatatataaccttaggcctttgtacctggctgatcaaagacatgtcaaaagtttatctgttcgctgttggtatagaaactaatacagtgtctgatgctattttaaggtagtcttatgtcttcacatattggctaatagatgtttccgctgtcgtgtccatatacttctgtgattatcacggtgctccgtctatcaaaattgtactaaaaggtattttgcaatgtgtgattggttaacagattattttgttttcaggatgcttgcacaagcatggtcggaaattttctcgaatatgttattgaaaatcaccgaatctacgaagagccagccactacttttcaggcattccagatagccctggtatgacagcatttactttgataatttatgcattgtttccttcatcatctgcctttgtttagaatgtcctcagaaggcagcactcctttagttttaactttccaatcataggattcaaatatccattaactggcctttgatcgctgcataatatatgaatagttgacatactgaatacgttgttaataatgcattttcagagttggattgcagccttgttggtaaagcaaattcttagccacaaagaatctctggtccgtgcaaattctgaattagctttcaaatgctctagagtagaggtggattatatttattcgatattgtcctgcatgaagagtctgttcctggagcatacacaaggtttgcagttcgattgctttggtactaattctaaacagtcagtggttagcacaaaactagtaaatgaaagtctctcaggggctacagtgcgtgacgaaaagattaatacgaagtcgatgcgaaatagctcagaggatgaagagtgcatgactgagaagagatgtagccattatagcacagcaacaagagatatcgaaaagactattagtggcataaaaaagaaatacaagaagcaagtgcaaaagcttgtacaagagcatgaggaaaagaaaatggagctgttaaatatgtatgcagacaagaagcagaaacttgaaactagtaaaagtgtggaagcagcagtaattcgtattacctgttcacggaccagtactcaagtgggtgatctcaaactgctggatcataattatgaaagaaagtttgatgaaatcaaaagtgagaaaaatgaatgcctcaaaagtctggagcaaatgcacgatgttgcaaagaagaagttggctgaggatgaagcctgttggattaatcggataaagagctgggcagctaaattaaaagtttgtgttcccattcaaagtggcaataacaagcattttagtggttcatcaaacatttcccaaaatgctcctgatgtacaaatttgcaataatgctaacgttgaagctacttacgctgatacgaattgcatggcttccaaggttaatcaagtgccagaagcagaaaacacattaggaaccatgtcgggtggcagcactcaacaagttcatgaaatggtggatgtaagaaatgacgagacaatggatgtctcagctttgtctcgtgaacagcttacaaagagccagtccaatgagcacgcttctatcactgtgcctgagattttgattcctgctgactgtcaagaggaatttgcggccttgaacgtgcatttgtcagaagaccagaattgtgacagaataacatctgcggcatcagatgaagatgtttcatcaagggtgccagaggtatcccagtcactcgaaaatctttctgcctcccccgagttttctctaaatagagaggaggctttggttacaacagaaaatagaagaacaagtcatgtgggttttgatactgataacattttggaccagcagaatagagaagattgttctcttgaccaagagattcctgacgagttagcgatgcctgtgcaacatcttgcgtctgtggtagagactaggggtgctgctgaatctgatcaggtacttactggccctgtagaatagttgatgccttgttcatttaatcttttctaatgttcattcttgctttcttgaaaataacgggtagtgatcagatgtctttttttctcttattaaattcacttttctggacagtatggtcaagatatatgtcctatgccttcttcactggctggaaagcaacctgacccagcagcaaacactgagagcgaaaatcttgaagaagcaattgagcctcagtctgctggttcagaaacagtagagactactgattttgctgcatcacatcaggtccctattgaagactttccttttttactagtttaaagttatcaatctgtgttatgttcattctaagtttccgtgagaaaaaggtggggaaatgtggttactgatcaagtctcgttgttgttttaaatcgactcttttgacagggtgatcaagttacatgtcctttgctatcttcaccgactggaaatcagcctgcgccagaagcaaatattgaaggccaaaatatcaacacatcagctgagccccatgtagcgggtccagatgcagtagagagtggtgattatgcagtaatagatcaggttattgccttaactaaagacaaatgtcttttgttgtttaaaagtcttacatctttgtaatgctcgttctggatatcctgcaggaaacaatgggtgctcaggatgcatgctctctgccatctggatcggttggaactcagtctgacctaggagcaaacattgagggtcaaaatgtcacaacagtggctcaacttcccacagatggatcagatgcagttgtaaccggtggatctcctgtatcagatcaggtacctgcctctgctcaaggactttcttatgtgttggtttaaaggtctagtccttagtaatgttgaaactaagcaaacagtggatagtgatcatatggttatttttgcttgtgaatttaatatttctggacagtgtgcccaggatgcatctcctatgccattatcttcgcctggaaatcaccctgatacagcagttaatatcgagggtttagataacacatcagtagctgagcctcatataagtggatcagatgcatgtgaaatggaaatttcagaacctggtccccaagtagagcggtcaacctttgcaagtcagtaactgccttgggcatttttaagtatcacctaggtcgacatatgtgattgccaaacagctaacaaggagatgccttttgtgcagatcttttccatgaaggtggcgtggagcattcagcaggtgtaacagctcttgttccatcacttcttaacaatggtacggaacagattgccgttcaacctgttcctcaaatacctttccctgtgttcaacgacccgtttctgcatgaactggagaagttgcggagagaatcagagaactcaaagaagacttttgaagaaaaagtcagtttccctcattacccagttacctcttgttttggtttattttctagctgcccattgactctcagttgcttgtgagcagaaatcaatcttgaaagctgaactcgagaggaagatggctgaagtacaagcagagtttcgaagaaaatttcatgaggtagaagccgagcataacaccagaacgacaaagatagagaaggataagaatcttgttataatgaacaaactgttggcgaatgcgttcttgtccaaatgtactgacaagaaggtatctccctcaggagctccaaggggtaagtgtcgaataatatagcaaattggttttaaaaataaggcgacgaagtcataatagcactttttctccaggtaaaattcagcagctagcacagagagcagcacaagtgagtgcactgagaaattacattgctcctcagcagcttcaggcatcttcttttcctgctcctgctctggtttcggctcctctgcaacttcagcaatcatcatttcctgctcctggtccggctcctctgcagcctcaggcatcttcgtttccttcttcagtctctcgtccatcagcccttcttctgaattttgcggtctgtccaatgcctcagcccagacagcctctcatatccaacatagctccaactccatcagttactcctgcaacaaatccaggtctgcgttctcctgcaccacacctaaactcatatagaccatcctcttcaactcccgtcgccacagctactccaacctcgtcagtgcctcctcaagctttgacatattcagctgtgtcaattcagcagcagcaagaacaacaaccgcaacagagcttgagcagtggattgcagagcaacaatgaagtggtttgtctttctgacgacgagggttcgaaatcgataagcttggatcctctagaccctttgcctgctgccgctgccgctgactacaaagaccatgacggtgattataaagatcatgatatcgattacaaggatgacgatgacaagggactagacttggctgccgctgccgctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgagtgacctaagaggagagatggttagggtcttagttattgatttttagagagttaataatagtatatatatatatgtataagtaggttacctaatctctgtcgttaatctaatttagtgagtcaggaaccgactcgttggctaaggtctctccttttgaaacgcaacgttctactttcatgtatataaatacagtctgatcacacaacacaaattgatgattgaaaatactactgatttaactt

SEQ ID NO: 735 - DNA, 596 bp, Artificial Sequence
  Synthetic Construct
cacaagcatgagtttttccttccggtaatcgtaaaatcaaaaatcgctcgctcgagaaacgccggtgctagaagaggaaagtaccgtacataatcctgcgaacccaattctcgtcttcttcaaactcagttttccgaaaccccaaacaccgcgaggattgcatggcctgaagaaccacttaatcgagaattgtgctggaattctcaaattttccctcgcgtttttctttcacactctcggaatcggaaatttccaccaagctccgtcaagcgatagattctgacaattacacactttcgcgcaggtatgcttccttccctgttttaggttggtgttaatctatcggtgaatcgaaggttttgggcctcgggctttgcgttttaggtttttcagagaatcttatctacttggggatggatcttaggcgtttgttagatgtaactcattagttttgcatataggaattttgatttgaaagttaggtcgccggatttgtagacattttgtttgatggtcttcttcggtgctcacattctttgtttttaagtgcttgatttggttgctaaggtcctttccgttgcgtgctctcagtgaat

SEQ ID NO: 736 - DNA, 8505 bp, Artificial Sequence
  Synthetic Construct
atgaagaaagatgaaaagattggtttgacggggagaaccatttacaccagatccctagcagcttcaattcctgcctcagttgaacaagaaacccctggtttgaggaggtcaagccgggggacaccatctacgaaggtaataactccagcttctgctactagaaagtcagagagactggctccctcacctgcttcagtttcaaaaaagtccggtggaatcgtcaagaattccacaccaagttctttgcgaaggtccaatagggggaagactgaagtatccttgcagagttccaaaggatcagataattctatcaggaaaggagatacttcaccggatattgagcagagaaaggatagtgttgaagagtcgacagataagatcaagcctataatgtcagcccgaagttacagggcattgtttagagggaagctcaaggaatctgaggcattagttgatgcttccccaaatgaagaggaactagtagttgttggttgttctcgccgcatacctgcaggcaatgatgatgttcaaggtaaaacagattgtccaccacctgcagatgcaggatcaaaaaggctgccagttgacgaaactagtttggacaagggcactgattttcctttgaaatcagttacggagaccgagaagatagtgcttgatgcatcccccatagttgaaactggggatgacagtgttataggttcaccatctgagaatttagagacacaaaagcttcaagatggtaagacagattgttcaccacctgcaaatgcagaatcgaaaacgctgccagttggtgaaactagtttagaaaaagaatatccacaaaagtttcaagatgataacacagattgtctaccacctgcaaatgcagaatcaaaaaggctgccagttggcgaaactagtttagaaaaggacactgattttcctttgaaatcaactacggagactggaaagatggttctttatgcatcccccatagttgaaactagggatgacagcgttatatgttcaccatctacaaatttagaaacccaaaagcttcttgtcagtaaaactggcttagaaaccgacatagttttgcctttgaaaagaaaaagagacactgcagaaattgagctggatgcatgtgctacagttgcaaatggagatgatcacgttatgagttctgatggggtcattccatctccatctgggtgcaaaaatgataatcgacctgaaatgtgcaacacgtgtaaaaaacggcaaaagtaagagtttttttagtgttgtctgtctattgaaacgatctgccaatgttgaatgttgggcagatgggtttgattcttaggatatatgttctgtattgtaatgagttgttcaaaattttgaagggtcaacggtgattgtcaaaataggagtgtttgctcctgcattgtccagccagttgaagaatctgataacgtgacacaggttggtttctaattactttcggagacccgttaatcagtggactcttaaatagttagatactagatttacttatccttttacttgtaatctgcaattctattttgcatttgattaggatatgaaagaaactggaccagttacgagcagagaatatgaggagaacgggcaaatacaacatggtaaatcaagtgatcccaaattctattcttcggtgtacccagagtattgggttcctgtgcagctatcagatgtacagctggagcaatactgtcagactctcttctccaaatccttatctctttcttcactttcgaagattgatcttggagctctagaagaaactctcaattctgtaagaaaagtaagttacttgattttaaaaacacttattcttcaatgcacttgtgagttaagtacccagttattactggtgataagataaagaaagcaatagaaaaattgataaggtgttcaccgcattgcagccaaaaaaacaattctgtgttccatgctttcaagaggttgtcacataggtgttatgcctttctgtttgatgtttggtagagcaaaggttttgggtctatttgttttatgcttttttgaaacacatagaacctggcaaacttgacagttttggggttgcttagatatacgactattgtcggtcagcatcacattttctcaaggcctctttctgcatgttaatgtgtgaatatattaaaatcttctttatgtgtttgcaacttgttgacagacctgtgaccatccatacgttatggatgcatctttgaaacaactgctcaccaagaatctggagttgcatgaaatcctggatgtagaaattaaagcgagcgggaaacttcacctccttgataaaatgcttactcatataaaaaagaatggtttaaaagcagttgtcttctaccaggtgcattttctattacttgcgaatgtgaatagctctatgtttgtcatgaatacgtcactttgtgcattctcaatatatgtgcattttctttttgacaatggaattctgtcttgtattgaaatttgagtgggatgaaagtatgctttttatcgtgcaattatgaagtgtaagttagccttcagcagtcagctagcattatgagatatgctgaactaaaatgtttcttttctcttctttctttttcgttatatgtgcctcatgtatgtttgaattacagtttttattttcagcaggcaacacaaacccctgaagggcttctgcttggtaatattctcgaagattttgtgggtcaaagatttggtccaaaatcttatgagcatgggatatattcctcaaagaagaactccgctataaacaatttcaacaaggagagtcaatgctgtgttctgctgttggaaacacgtgcctgcagtcaaaccattaaactcttgcgagctgatgcgtttattctttttggaagcagcttgaatccatcgcatgatgttaagcacgtagagaagataaaaatcgagtcatgttctgaaagaactaagatattccgattgtactcagtatgtacagttgaagaaaaagccctgattctggctaggcaaaataagcggcaaaataaagctgtagagaacctaaaccgctctctcacgcacgcactgctcatgtggggggcgtcatacttatttgataaactggatcattttcacagcagtgaaactccagattcaggagtttcatttgaacaatctattatggacggcgtgattcatgaattctcgtccatactttcttccaaaggtggagaagaaaatgaagtcaagctgtgtctacttttggaggccaagcatgctcagggaacttacagcagtgattctactctatttggtgaagaccatattaagttgtcagatgaagagagtccaaatatattttggtcaaagctgttggggggaaaaaatcctatgtggaaatacccttcagatactccccaaaggaatcgaaaacgagttcagtattttgagggttctgaagcgagtcccaaaactggcgatggtggaaatgcaaagaagcgaaagaaggcttctgatgatgtcactgatccccgggtcactgatccgccagtagatgatgatgaaagaaaggcctctgggaaggatcacatgggtaaaatagtttaatttctgctccgatacctctagtgttcattgattatgcaactactttgctgactatctttcctacaggggctttggagtcaccaaaagtcataacactccagtcatcatgtaaatcttctggtacagatggtacattggatggaaatgatgcttttggcttgtattctatgggcagccatatctctggaatcccagaggatatgttagctagtcaagattgggggaaaataccggatgaatcacagaggaggctccacactgttttaaagccgaagatggcaaaactttgccaagttttgcatctttcagtaagtggcctttttcacctccacaacttattttagccttgcatatgcttatatatagctgattgcaactgtagttgttacctgatttcctgttacagccaaatgtgagagttttattcttcaactatatccatccgtttaagcatattttatttcttatatctggcttcgttaccaatgcactgttaaaatgagcaactgctgcacaaaacagtaggtagttatgtgcctcatgtcattcattgtttattgaagcaaagaaatttctgtctactttacatgatccatctgtgggagtatataactatatataaccttaggcctttgtacctggctgatcaaagacatgtcaaaagtttatctgttcgctgttggtatagaaactaatacagtgtctgatgctattttaaggtagtcttatgtcttcacatattggctaatagatgtttccgctgtcgtgtccatatacttctgtgattatcacggtgctccgtctatcaaaattgtactaaaaggtattttgcaatgtgtgattggttaacagattattttgttttcaggatgcttgcacaagcatggtcggaaattttctcgaatatgttattgaaaatcaccgaatctacgaagagccagccactacttttcaggcattccagatagccctggtatgacagcatttactttgataatttatgcattgtttccttcatcatctgcctttgtttagaatgtcctcagaaggcagcactcctttagttttaactttccaatcataggattcaaatatccattaactggcctttgatcgctgcataatatatgaatagttgacatactgaatacgttgttaataatgcattttcagagttggattgcagccttgttggtaaagcaaattcttagccacaaagaatctctggtccgtgcaaattctgaattagctttcaaatgctctagagtagaggtggattatatttattcgatattgtcctgcatgaagagtctgttcctggagcatacacaaggtttgcagttcgattgctttggtactaattctaaacagtcagtggttagcacaaaactagtaaatgaaagtctctcaggggctacagtgcgtgacgaaaagattaatacgaagtcgatgcgaaatagctcagaggatgaagagtgcatgactgagaagagatgtagccattatagcacagcaacaagagatatcgaaaagactattagtggcataaaaaagaaatacaagaagcaagtgcaaaagcttgtacaagagcatgaggaaaagaaaatggagctgttaaatatgtatgcagacaagaagcagaaacttgaaactagtaaaagtgtggaagcagcagtaattcgtattacctgttcacggaccagtactcaagtgggtgatctcaaactgctggatcataattatgaaagaaagtttgatgaaatcaaaagtgagaaaaatgaatgcctcaaaagtctggagcaaatgcacgatgttgcaaagaagaagttggctgaggatgaagcctgttggattaatcggataaagagctgggcagctaaattaaaagtttgtgttcccattcaaagtggcaataacaagcattttagtggttcatcaaacatttcccaaaatgctcctgatgtacaaatttgcaataatgctaacgttgaagctacttacgctgatacgaattgcatggcttccaaggttaatcaagtgccagaagcagaaaacacattaggaaccatgtcgggtggcagcactcaacaagttcatgaaatggtggatgtaagaaatgacgagacaatggatgtctcagctttgtctcgtgaacagcttacaaagagccagtccaatgagcacgcttctatcactgtgcctgagattttgattcctgctgactgtcaagaggaatttgcggccttgaacgtgcatttgtcagaagaccagaattgtgacagaataacatctgcggcatcagatgaagatgtttcatcaagggtgccagaggtatcccagtcactcgaaaatctttctgcctcccccgagttttctctaaatagagaggaggctttggttacaacagaaaatagaagaacaagtcatgtgggttttgatactgataacattttggaccagcagaatagagaagattgttctcttgaccaagagattcctgacgagttagcgatgcctgtgcaacatcttgcgtctgtggtagagactaggggtgctgctgaatctgatcaggtacttactggccctgtagaatagttgatgccttgttcatttaatcttttctaatgttcattcttgctttcttgaaaataacgggtagtgatcagatgtctttttttctcttattaaattcacttttctggacagtatggtcaagatatatgtcctatgccttcttcactggctggaaagcaacctgacccagcagcaaacactgagagcgaaaatcttgaagaagcaattgagcctcagtctgctggttcagaaacagtagagactactgattttgctgcatcacatcaggtccctattgaagactttccttttttactagtttaaagttatcaatctgtgttatgttcattctaagtttccgtgagaaaaaggtggggaaatgtggttactgatcaagtctcgttgttgttttaaatcgactcttttgacagggtgatcaagttacatgtcctttgctatcttcaccgactggaaatcagcctgcgccagaagcaaatattgaaggccaaaatatcaacacatcagctgagccccatgtagcgggtccagatgcagtagagagtggtgattatgcagtaatagatcaggttattgccttaactaaagacaaatgtcttttgttgtttaaaagtcttacatctttgtaatgctcgttctggatatcctgcaggaaacaatgggtgctcaggatgcatgctctctgccatctggatcggttggaactcagtctgacctaggagcaaacattgagggtcaaaatgtcacaacagtggctcaacttcccacagatggatcagatgcagttgtaaccggtggatctcctgtatcagatcaggtacctgcctctgctcaaggactttcttatgtgttggtttaaaggtctagtccttagtaatgttgaaactaagcaaacagtggatagtgatcatatggttatttttgcttgtgaatttaatatttctggacagtgtgcccaggatgcatctcctatgccattatcttcgcctggaaatcaccctgatacagcagttaatatcgagggtttagataacacatcagtagctgagcctcatataagtggatcagatgcatgtgaaatggaaatttcagaacctggtccccaagtagagcggtcaacctttgcaagtcagtaactgccttgggcatttttaagtatcacctaggtcgacatatgtgattgccaaacagctaacaaggagatgccttttgtgcagatcttttccatgaaggtggcgtggagcattcagcaggtgtaacagctcttgttccatcacttcttaacaatggtacggaacagattgccgttcaacctgttcctcaaatacctttccctgtgttcaacgacccgtttctgcatgaactggagaagttgcggagagaatcagagaactcaaagaagacttttgaagaaaaagtcagtttccctcattacccagttacctcttgttttggtttattttctagctgcccattgactctcagttgcttgtgagcagaaatcaatcttgaaagctgaactcgagaggaagatggctgaagtacaagcagagtttcgaagaaaatttcatgaggtagaagccgagcataacaccagaacgacaaagatagagaaggataagaatcttgttataatgaacaaactgttggcgaatgcgttcttgtccaaatgtactgacaagaaggtatctccctcaggagctccaaggggtaagtgtcgaataatatagcaaattggttttaaaaataaggcgacgaagtcataatagcactttttctccaggtaaaattcagcagctagcacagagagcagcacaagtgagtgcactgagaaattacattgctcctcagcagcttcaggcatcttcttttcctgctcctgctctggtttcggctcctctgcaacttcagcaatcatcatttcctgctcctggtccggctcctctgcagcctcaggcatcttcgtttccttcttcagtctctcgtccatcagcccttcttctgaattttgcggtctgtccaatgcctcagcccagacagcctctcatatccaacatagctccaactccatcagttactcctgcaacaaatccaggtctgcgttctcctgcaccacacctaaactcatatagaccatcctcttcaactcccgtcgccacagctactccaacctcgtcagtgcctcctcaagctttgacatattcagctgtgtcaattcagcagcagcaagaacaacaaccgcaacagagcttgagcagtggattgcagagcaacaatgaagtggtttgtctttctgacgacgag

SEQ ID NO: 737 - DNA, 57 bp, Artificial Sequence; identical to SEQ ID NO: 723
  Synthetic Construct

SEQ ID NO: 738 - DNA, 66 bp, Artificial Sequence; identical to SEQ ID NO: 724
  Synthetic Construct

SEQ ID NO: 739 - DNA, 27 bp, Artificial Sequence
  Synthetic Construct
ggactagacttggctgccgctgccgct

SEQ ID NO: 740 - DNA, 513 bp, Artificial Sequence; identical to SEQ ID NO: 726
  Synthetic Construct

SEQ ID NO: 741 - DNA, 239 bp, Artificial Sequence
  Synthetic Construct
cctaagaggagagatggttagggtcttagttattgatttttagagagttaataatagtatatatatatatgtataagtaggttacctaatctctgtcgttaatctaatttagtgagtcaggaaccgactcgttggctaaggtctctccttttgaaacgcaacgttctactttcatgtatataaatacagtctgatcacacaacacaaattgatgattgaaaatactactgatttaactt

SEQ ID NO: 742 - protein, 2220 aa, Artificial Sequence
  Synthetic Construct
MKKDEKIGLTGRTIYTRSLAASIPASVEQETPGLRRSSRGTPSTKVITPASATRKSERLAPSPASVSKKSGGIVKNSTPSSLRRSNRGKTEVSLQSSKGSDNSIRKGDTSPDIEQRKDSVEESTDKIKPIMSARSYRALFRGKLKESEALVDASPNEEELVVVGCSRRIPAGNDDVQGKTDCPPPADAGSKRLPVDETSLDKGTDFPLKSVTETEKIVLDASPIVETGDDSVIGSPSENLETQKLQDGKTDCSPPANAESKTLPVGETSLEKEYPQKFQDDNTDCLPPANAESKRLPVGETSLEKDTDFPLKSTTETGKMVLYASPIVETRDDSVICSPSTNLETQKLLVSKTGLETDIVLPLKRKRDTAEIELDACATVANGDDHVMSSDGVIPSPSGCKNDNRPEMCNTCKKRQKVNGDCQNRSVCSCIVQPVEESDNVTQDMKETGPVTSREYEENGQIQHGKSSDPKFYSSVYPEYWVPVQLSDVQLEQYCQTLFSKSLSLSSLSKIDLGALEETLNSVRKTCDHPYVMDASLKQLLTKNLELHEILDVEIKASGKLHLLDKMLTHIKKNGLKAVVFYQATQTPEGLLLGNILEDFVGQRFGPKSYEHGIYSSKKNSAINNFNKESQCCVLLLETRACSQTIKLLRADAFILFGSSLNPSHDVKHVEKIKIESCSERTKIFRLYSVCTVEEKALILARQNKRQNKAVENLNRSLTHALLMWGASYLFDKLDHFHSSETPDSGVSFEQSIMDGVIHEFSSILSSKGGEENEVKLCLLLEAKHAQGTYSSDSTLFGEDHIKLSDEESPNIFWSKLLGGKNPMWKYPSDTPQRNRKRVQYFEGSEASPKTGDGGNAKKRKKASDDVTDPRVTDPPVDDDERKASGKDHMGALESPKVITLQSSCKSSGTDGTLDGNDAFGLYSMGSHISGIPEDMLASQDWGKIPDESQRRLHTVLKPKMAKLCQVLHLSDACTSMVGNFLEYVIENHRIYEEPATTFQAFQIALSWIAALLVKQILSHKESLVRANSELAFKCSRVEVDYIYSILSCMKSLFLEHTQGLQFDCFGTNSKQSVVSTKLVNESLSGATVRDEKINTKSMRNSSEDEECMTEKRCSHYSTATRDIEKTISGIKKKYKKQVQKLVQEHEEKKMELLNMYADKKQKLETSKSVEAAVIRITCSRTSTQVGDLKLLDHNYERKFDEIKSEKNECLKSLEQMHDVAKKKLAEDEACWINRIKSWAAKLKVCVPIQSGNNKHFSGSSNISQNAPDVQICNNANVEATYADTNCMASKVNQVPEAENTLGTMSGGSTQQVHEMVDVRNDETMDVSALSREQLTKSQSNEHASITVPEILIPADCQEEFAALNVHLSEDQNCDRITSAASDEDVSSRVPEVSQSLENLSASPEFSLNREEALVTTENRRTSHVGFDTDNILDQQNREDCSLDQEIPDELAMPVQHLASVVETRGAAESDQYGQDICPMPSSLAGKQPDPAANTESENLEEAIEPQSAGSETVETTDFAASHQGDQVTCPLLSSPTGNQPAPEANIEGQNINTSAEPHVAGPDAVESGDYAVIDQETMGAQDACSLPSGSVGTQSDLGANIEGQNVTTVAQLPTDGSDAVVTGGSPVSDQCAQDASPMPLSSPGNHPDTAVNIEGLDNTSVAEPHISGSDACEMEISEPGPQVERSTFANLFHEGGVEHSAGVTALVPSLLNNGTEQIAVQPVPQIPFPVFNDPFLHELEKLRRESENSKKTFEEKKSILKAELERKMAEVQAEFRRKFHEVEAEHNTRTTKIEKDKNLVIMNKLLANAFLSKCTDKKVSPSGAPRGKIQQLAQRAAQVSALRNYIAPQQLQASSFPAPALVSAPLQLQQSSFPAPGPAPLQPQASSFPSSVSRPSALLLNFAVCPMPQPRQPLISNIAPTPSVTPATNPGLRSPAPHLNSYRPSSSTPVATATPTSSVPPQALTYSAVSIQQQQEQQPQQSLSSGLQSNNEVVCLSDDEGSKSISLDPLDPLPAAAAADYKDHDGDYKDHDIDYKDDDDKGLDLAAAAALEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEPYKCPECGKSFSRSDKLTEHQRTHTGLE

SEQ ID NO: 743 - protein, 2001 aa, Artificial Sequence; identical to SEQ ID NO: 694
  Synthetic Construct

SEQ ID NO: 744 - protein, 19 aa, Artificial Sequence
  Synthetic Construct
GSKSISLDPLDPLPAAAAA

SEQ ID NO: 745 - protein, 22 aa, Artificial Sequence
  Synthetic Construct
DYKDHDGDYKDHDIDYKDDDDK

SEQ ID NO: 746 - protein, 9 aa, Artificial Sequence
  Synthetic Construct
GLDLAAAAA

SEQ ID NO: 747 - protein, 169 aa, Artificial Sequence; identical to SEQ ID NO: 733
  Synthetic Construct

SEQ ID NO: 748 - protein, 395 aa, Mycoplasma penetrans
MNSNKDKIKVIKVFEAFAGIGSQFKALKNIARSKNWEIQHSGMVEWFVDAIVSYVAIHSKNFNPKIEQLDKDILSISNDSKMPISEYGIKKINNTIKASYLNYAKKHFNNLFDIKKVNKDNFPKNIDIFTYSFPCQDLSVQGLQKGIDKELNTRSGLLWEIERILEEIKNSFSKEEMPKYLLMENVKNLLSHKNKKNYNTWLKQLEKFGYKSKTYLLNSKNFDNCQNRERVFCLSIRDDYLEKTGFKFKELEKVKNPPKKIKDILVDSSNYKYLNLNKYETTTFRETKSNIISRSLKNYTTFNSENYVYNINGIGPTLTASGANSRIKIETQQGVRYLTPLECFKYMQFDVNDFKKVQSTNLISENKMIYIAGNSIPVKILEAIFNTLEFVNNEE

SEQ ID NO: 749 - protein, 372 aa, Acholeplasma sp. CAG:878
MKKIRVFETFSGIGAQNKALKNSGLDYEVVATSDWFIDAILAYDAIHCKDEKISVPSYEKQIEYLSKFTFSGDSVKPYHNLMKKSKKEIKKLYIANKRTKNLGSITEITSKVIPDHDLLTYSFPCQDLSTGGKTRGMSKGSGTRSGLLWEIERILGELNNEGRLPKYLLMENVKAILAPSNKRDFEMWKKFLEDLGYKNEVMVLSGIYFGVPQDRARCFMVSILGNKKPKIEKRLKKNSYPASDIKKFLKTDYTNKTYKKEADEAQLPRTRSRELMWNINKRDVENLTYFNTITCNMDRQNNAGMILYDGPKGNSYRLLTAREAFLLMGFSEEDFENVKKLGLSYRKMIKLAGNSIVVPVLEAIFKVMFEEK

SEQ ID NO: 750 - protein, 248 aa, Mycoplasma hyosynoviae
SQQGLQKGITKTTRSGLLYEIERILLLNKDRLPKILLLENVKALTSKKFINDLNSWIETLNKLGYTSYYKVLNSQDYGSSQNRERIFMISIFNANGKKFNFENKTTHFKKLEDILDENYSKKLVLLNLNKYEKSDFITTKNSITKARLLNYSNFNSETYIYLPKGIGPTLTASGANSRLKFYYESNKEIRLISYYEAYEYMGFSKKYAHIIKEQDIISEEKMIFTCGNSISVEVLEKIFEELIENGFF

SEQ ID NO: 751 - protein, 454 aa, Mesoplasma seiffertii
MSKSKIRVFETFAGIGAQHKALEILKKQDFLDYEVVATSEWDIWANISYNAIHHNNKNIAKPLKDKELNDFFDKFDLSNDSKKVADKMFVKRLPRTTKEILYSSMVNSNNLGSILNITGESLINSITKESTKNSYQTGVDLITYSFPCQDLSTAGNFHNSNKGMKKGSGTRSGLLWEIERILRELKVLNQLPKYLLLENVRNMLSNKHIDDYREWLSFLHDELGYNTQTYQLNAKDYDSPQARTRVYALSVLGEDDQNFHDSFAKNNRVIEVETIPKNVSSQLKIKKKLHQVLKTDYTKQEYLEEASKATPNLTPSRVKMYCENPILHLSNISEAKYQSQYQKIGSNGYYMNYSRTVTTKQDRNPNSGMISIENSLLIKEHENNPLKKNMHYRLLTPRETYLLMGFEEKDVKKIFENDFISQAVRYRQAGNSIVVNVLVAIFKKVAELEYKEEE

SEQ ID NO: 752 - protein, 416 aa, Clostridium diolis
MVFRVIEAFSGIGSQAKALKNIGIEFEILATVDWDINAIIAYDIIHNGVPDLDKYKLKTKEELIKVLSKYTLSSDGKKPLDETAIKRMNRNVMEHLVAAIDRSKNLVSITDVRGENLPNDIDLFTYSFPCQDLSIAGAWHGNNSGIDRDANNRSGMLWEVERILMERNDLGLTMPKFLLMENVSNILCNTHKSNFEEWQNNLEYMGYYNKIYKLNASDFGIPQKRERVYMVSVLCEGNIKKAVKEYIDNNDLSIPMYINNINVERVGLEDILRVDYSNEVYKKEADESQPNDTESRRKIYQENDLLYDGNQVLRDVVTTITTKQDRNPNSGVIEYSAQNENKSNYRYLTPRECFMLMGFDEHDFQALIDNNFPVTKSMDFFVASKLYKMAGNSIVVNVLEAIFRQIEDIKNNILNN

SEQ ID NO: 753 - protein, 408 aa, Streptococcus sanguinis
MIETFSGIGSQTQALKNLRIDHKVVAIAEWDISAMYAYDILHNGEQDIKSLRHHTKESLISVLSRYNLSSNGKNPITLKALKSMSIAQLKAIYLSIERNNNLVDISEVHSQDLPDADILTYSFPCQDLSVSGYWHNNTSGIDRDAENRSTLLWQIERILKEYVASQKKLPRFLLMENVSNILSQRHIDNFNEWKTFLESLGYINKVYTLDARNFGVPQARKRTFMLSVLAENDIEIRRIDEYLNANDLQTFKTTQLKNISDFLRLDYSVEKYKKEAIESTPRFTESRKKIFRDNIVLATGTKINASAAKTVTTKQDRNPNSGIIKYAKNDYLVEWNTHYRNLTPRECFMLMGFKEEQFDLLLLNNFENKKGSYFLTASKLIKMAGNSIVVPILEEIFKQMEEIKKVLD

SEQ ID NO: 754 - protein, 403 aa, Mycoplasma penetrans HF-2
MDSNKDKIKVIKVFEAFAGIGSQFKALKNIARSKNWEIQHSGMVEWFVDAIVSYVAIHSKNFNPKIERLDRDILSISNDSKMPISEYGIKKINNTIKASYLNYAKKHFNNLFDIKKVNKDNFPKNIDIFTYSFPCQDLSVQGLQKGIDKELNTRSGLLWEIERILEEIKNSFSKEEMPKYLLMENVKNLLSHKNKKNYNTWLKQLEKFGYKSKTYLLNSKNFDNCQNRERVFCLSIRDDYLEKTGFKFKELEKVKNPPKKIKDILVDSSNYKYLNLNKYETTTFRETKSNIISRPLKNYTTFNSENYVYNINGIGPTLTASGANSRIKIETQQGVRYLTPLECFKYMQFDVNDFKKVQSTNLISENKMIYIAGNSIPVKILEAIFNTLEFVNNEELEHHHHHH

SEQ ID NO: 755 - protein, 327 aa, Haemophilus parahaemolyticus
MIEIKDKQLTGLRFIDLFAGLGGFRLALESCGAECVYSNEWDKYAQEVYEMNFGEKPEGDITQVNEKTIPDHDILCAGFPCQAFSISGKQKGFEDSRGTLFFDIARIVREKKPKVVFMENVKNFASHDNGNTLEVVKNTMNELDYSFHAKVLNALDYGIPQKRERIYMICFRNDLNIQNFQFPKPFELNTFVKDLLLPDSEVEHLVIDRKDLVMTNQEIEQTTPKTVRLGIVGKGGQGERIYSTRGIAITLSAYGGGIFAKTGGYLVNGKTRKLHPRECARVMGYPDSYKVHPSTSQAYKQFGNSVVINVLQYIAYNIGSSLNFKPY

SEQ ID NO: 756 - DNA, 4782 bp, Artificial Sequence; identical to SEQ ID NO: 663
  Synthetic Construct

SEQ ID NO: 757 - DNA, 1992 bp, Artificial Sequence; identical to SEQ ID NO: 658
  Synthetic Construct

SEQ ID NO: 758 - DNA, 630 bp, Artificial Sequence; identical to SEQ ID NO: 659
  Synthetic Construct

SEQ ID NO: 759 - DNA, 97 bp, Artificial Sequence; identical to SEQ ID NO: 660
  Synthetic Construct

SEQ ID NO: 760 - DNA, 1161 bp, Artificial Sequence; identical to SEQ ID NO: 661
  Synthetic Construct

SEQ ID NO: 761 - DNA, 739 bp, Artificial Sequence; identical to SEQ ID NO: 662
  Synthetic Construct

SEQ ID NO: 762 - protein, 649 aa, Artificial Sequence
  Synthetic Construct
MVGYQQMAGGLNDIFEAQKIEWHEDTGGSSIPGLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEDYKDDDDKDYKDDDDKDYKDDDDKKLDIAMGGAPSYQTSLYKKAGSAAAPFTMSKVENKTKKLRVFEAFAGIGAQRKALEKVRKDEYEIVGLAEWYVPAIVMYQAIHNNFHTKLEYKSVSREEMIDYLENKTLSWNSKNPVSNGYWKRKKDDELKIIYNAIKLSEKEGNIFDIRDLYKRTLKNIDLLTYSFPCQDLSQQGIQKGMKRGSGTRSGLLWEIERALDSTEKNDLPKYLLMENVGALLHKKNEEELNQWKQKLESLGYQNSIEVLNAADFGSSQARRRVFMISTLNEFVELPKGDKKPKSIKKVLNKIVSEKDILNNLLKYNLTEFKKTKSNINKASLIGYSKFNSEGYVYDPEFTGPTLTASGANSRIKIKDGSNIRKMNSDETFLYIGFDSQDGKRVNEIEFLTENQKIFVCGNSISVEVLEAIIDKIGG

SEQ ID NO: 763 - protein, 169 aa, Artificial Sequence
  Synthetic Construct
LEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGL

SEQ ID NO: 764 - protein, 27 aa, Artificial Sequence
  Synthetic Construct
DYKDDDDKDYKDDDDKDYKDDDDKKLD

SEQ ID NO: 765 - protein, 386 aa, Artificial Sequence; identical to SEQ ID NO: 680
  Synthetic Construct

SEQ ID NO: 766 - DNA, 2018 bp, Artificial Sequence; identical to SEQ ID NO: 434
  Synthetic Construct

SEQ ID NO: 767 - DNA, 7099 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccaacggtccgactgacgccgcggaagaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggc

SEQ ID NO: 768 - DNA, 1994 bp, Artificial Sequence; identical to SEQ ID NO: 431
  Synthetic Construct

SEQ ID NO: 769 - DNA, 115 bp, Artificial Sequence; identical to SEQ ID NO: 419
  Synthetic Construct

SEQ ID NO: 770 - DNA, 4107 bp, Artificial Sequence
  Synthetic Construct
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcc

SEQ ID NO: 771 - DNA, 27 bp, Artificial Sequence
  Synthetic Construct
tatccctatgacgtgcccgattatgcc

SEQ ID NO: 772 - DNA, 21 bp, Artificial Sequence
  Synthetic Construct
cccaagaaaaaacgcaaggtg

SEQ ID NO: 773 - DNA, 60 bp, Artificial Sequence; identical to SEQ ID NO: 442
  Synthetic Construct

SEQ ID NO: 774 - DNA, 723 bp, Artificial Sequence
  Synthetic Construct
gaagaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggc

SEQ ID NO: 775 - DNA, 768 bp, Artificial Sequence; identical to SEQ ID NO: 433
  Synthetic Construct

SEQ ID NO: 776 - protein, 1661 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVDGIGSGSNGSSGSNGPTDAAEEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 777 - protein, 1369 aa, Artificial Sequence; identical to SEQ ID NO: 439
  Synthetic Construct

SEQ ID NO: 778 - protein, 9 aa, Artificial Sequence
  Synthetic Construct
YPYDVPDYA

SEQ ID NO: 779 - protein, 7 aa, Artificial Sequence
  Synthetic Construct
PKKKRKV

SEQ ID NO: 780 - protein, 20 aa, Artificial Sequence
  Synthetic Construct
DGIGSGSNGSSGSNGPTDAA

SEQ ID NO: 781 - protein, 241 aa, Artificial Sequence; identical to SEQ ID NO: 443
  Synthetic Construct

SEQ ID NO: 782 - DNA, 5262 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacacctagggtttatgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccggtcgtacgggcggtggcggaggggagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacatggcggtggcggaggggctccaaagaagaagagaaaggtccgtacgggaggaggatctcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggtggtagcggtggtggtactagtccaaaaacaaggaggagaccgcgaagatcacaacggaaaaggccgcctacgccatggccgtaagtttgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttac

SEQ ID NO: 783 - DNA, 1994 bp, Artificial Sequence; identical to SEQ ID NO: 431
  Synthetic Construct

SEQ ID NO: 784 - DNA, 831 bp, Artificial Sequence
  Synthetic Construct
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagc

SEQ ID NO: 785 - DNA, 711 bp, Artificial Sequence
  Synthetic Construct
agcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaa

SEQ ID NO: 786 - DNA, 15 bp, Artificial Sequence
  Synthetic Construct
ggcggtggcggaggg

SEQ ID NO: 787 - DNA, 1062 bp, Artificial Sequence
  Synthetic Construct
gagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacat

SEQ ID NO: 788 - DNA, 24 bp, Artificial Sequence
  Synthetic Construct
gctccaaagaagaagagaaaggtc

SEQ ID NO: 789 - DNA, 165 bp, Artificial Sequence
  Synthetic Construct
gagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaa

SEQ ID NO: 790 - DNA, 63 bp, Artificial Sequence
  Synthetic Construct
ccaaaaacaaggaggagaccgcgaagatcacaacggaaaaggccgcctacgccatggccgtaa

SEQ ID NO: 791 - DNA, 263 bp, Artificial Sequence; identical to SEQ ID NO: 435
  Synthetic Construct

SEQ ID NO: 792 - protein, 996 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGSLDPGGGGSGSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKGGGRTGRTGGGGGETIRLPKPMIGFGVPTEPLPAMVRRTLPEQAVGPPFFYYENVALAPKGVWDTISRFLYDIEPEFVDSKYFCAAARKRGYIHNLPVENRFPLFPLAPRTIHEALPLSKKWWPSWDPRTKLNCLQTAIGSAQLTNRIRKAVEDFDGEPPMRVQKFVLDQCRKWNLVWVGRNKVAPLEPDEVEMLLGFPKNHTRGGGISRTDRYKSLGNSFQVDTVAYHLSVLKDLFPGGINVLSLFSGIGGGEVALYRLGIPLNTVVSVEKSEVNRDIVRSWWEQTNQRGNLIHFNDVQQLNGDRLEQLIESFGGFDLVIGGSPCNNLAGSNRVSRDGLEGKESSLFYDYVRILDLVKSIMSRHKHGGGGGAPKKKRKVRTGGGSRTEEYKLILNGKTLKGETTTEAVDAATAEKVFKQYANDNGVDGEWTYDDATKTFTVTEGGGSGGGTSPKTRRRPRRSQRKRPPTPWP

SEQ ID NO: 793 - protein, 277 aa, Artificial Sequence; identical to SEQ ID NO: 445
  Synthetic Construct

SEQ ID NO: 794 - protein, 237 aa, Artificial Sequence; identical to SEQ ID NO: 446
  Synthetic Construct

SEQ ID NO: 795 - protein, 5 aa, Artificial Sequence
  Synthetic Construct
GGGGG

SEQ ID NO: 796 - protein, 354 aa, Artificial Sequence; identical to SEQ ID NO: 679
  Synthetic Construct

SEQ ID NO: 797 - protein, 8 aa, Artificial Sequence
  Synthetic Construct
APKKKRKV

SEQ ID NO: 798 - protein, 55 aa, Artificial Sequence; identical to SEQ ID NO: 449
  Synthetic Construct

SEQ ID NO: 799 - protein, 20 aa, Artificial Sequence
  Synthetic Construct
PKTRRRPRRSQRKRPPTPWP

SEQ ID NO: 800 - DNA, 553 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgacggaaagatgtatgggcttgttttagagctagaaatagcaagttaaaataaggctagtccgttatcaacttgaaaaagtggcaccgagtcggtgcttttttt

SEQ ID NO: 801 - DNA, 450 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattg

SEQ ID NO: 802 - DNA, 20 bp, Artificial Sequence
  Synthetic Construct
acggaaagatgtatgggctt

SEQ ID NO: 803 - DNA, 76 bp, Artificial Sequence; identical to SEQ ID NO: 638
  Synthetic Construct

SEQ ID NO: 804 - DNA, 7 bp, Artificial Sequence
  Synthetic Construct
ttttttt

SEQ ID NO: 805 - DNA, 820 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgaacaaagcaccagtggtctagtggtagaatagtaccctgccacggtacagacccgggttcgattcccggctggtgcagacggaaagatgtatgggcttgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaaaaactaggccatccatggagttttagagctagaaatagcaagttaaaataaggctagtccgttatcaacttgaaaaagtggcaccgagtcggtgcgtttaaacaaacttttttt

SEQ ID NO: 806 - protein, 24 aa, Artificial Sequence
  Synthetic Construct
EELLSKNYHLENEVARLKKGSGSG

SEQ ID NO: 807 - protein, 718 aa, Artificial Sequence
  Synthetic Construct
LPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 808 - protein, 912 aa, Homo sapiens
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 809 - protein, 909 aa, Pan Paniscus
MPSSGPGDTSSSAAEREEDRKDGEEQEEPRGKEERQEPSTTARKVGRPGRKRKHPPVESGDTPKDPAVISKSPSMAQDPGASELLPNGDLEKRSEPQPEEGSPAGGQKGGAPAEGEGAAETLPEASRAVENGCCTPKEGRGAPAEVGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 810 - protein, 908 aa, Rattus norvegicus
MPSSGPGDTSISSLEREDDRKEGEEQEENRGKEERQEPSATARKVGRPGRKRKHPPVESSDTPKDPAVTTKSQPTAQDSGPSDLLPNGDLEKRSEPQPEEGSPAAGQKGGAPAEGEGTETPPEASRAVENGCCVTKEGRGASAGEGKEQKQTNIESMKMEGSRGRLRGGLGWESSLRQRPMPRLTFQAGDPYYISKRKRDEWLARWKREAEKKAKVIAVMNAVEESQASGESQKVEEASPPAVQQPTDPASPTVATTPEPVGADAGDKNATKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDTGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 811 - protein, 909 aa, Rhinolophus sinicus
MPSSGPGDTSSSAPEREEDRKEGEEQEEARAKEERQEPSTTARKVGRPGRKRKHPLVESSDTPKDPPVTSKSPSMAQDSGPSELLPNGDLEKRSEPQPEEGSPAGGQKGGAPAEGEGAAETPPEASRAVENGCCTPKDGRGATTEEGKEQKETNIESMKMEGSRGRLRGGLGWESSLRQRPMPRLTFQAGDPYYISKRKRDEWLARWKREAEKKAKVIAVMNAVEENQGSGESQKVEEASPPAVQQPTDPASPTVATTPEPVGADAGDKNATKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRRDDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 812 - protein, 859 aa, Equus caballus
MVESSDTPKDPTVTSKSPSMAQDSGSSELLPNGDLEKRSEPQPEEGSPAGGQKGGAPAEGEGAAETPTEASRAVENGCCTPKDGRGAPAEEGKEQKETNIESMKMEGSRGRLRGGLGWESSLRQRPMPRLTFQAGDPYYISKRKRDEWLARWKREAEKKAKVIAVMNAVEENQGSGEAQKVEEASPPAVQQPTDPASPTVATTPEPVGADAGDKNVTKAADDEPEYEDGRGFGIGELVWGKLRGFSWWPGRIVSWWMTGRSRAAEGTRWVMWFGDGKFSVWLSLQVCVEKLMPLSSFCSAFHQATYNKQPMYRKAIYEVLQVASSRAGKLFPACHDNDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRRDDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 813 - protein, 854 aa, Ovis aries
MVESSDTPKDPALTSKSLSMAQDSGPSELLPNGDLEKRSEPQPEEGSPAGGQKGGAPAEGEGATETPPEASRAVENGCCTPKDGRGAPAEEGKEQKETNIESMKMEGSRGRLRGGLGWESSLRQRPMPRLTFQAGDPYYISKRKRDEWLARWKREAEKKAKVIAVMNAVEENQGSTESQKVEEASPPAVQQPTDPASPTVATTPEPVGADAGDKNATKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPMCHDSDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRRDDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 814 - protein, 888 aa, Bos Taurus
EGEEQEEARAKEERQEPSTTARKVGRPGRKRKHPPVESSDTPKDPAVTSKSLSMAQDSGPSELYPNGDLEKRSEPQPEEGSPAGGQKGGAPAEGEGATETPPEASRAVENGCCTPKDGRGAPAEEGKEQKETNIESMKMEGSRGRLRGGLGWESSLRQRPMPRLTFQAGDPYYISKRKRDEWLARWKREAEKKAKVIAVMNAVEENQGSTESQKVEEASPPAVQQPTDPASPTVATTPEPVGADAGDKNATKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPMCHDSDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRRDDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVVLGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 815 - protein, 910 aa, Orcinus orca
MPASGPGDASGPAPERGEEERKEGEEQEEARGKEERQEPSTTARKVGRPGRKRKHPPVESSDTPKDPAVTSKSPSMAQDSGPSELLPNGDLEKRSEPQPEEGSPAGGQKGGAPAEGEGAAETPPEASRAVENGCCTPKDGRGAPAEEGKEQKETNIESMKMEGSRGRLRGGLGWESSLRQRPMPRLTFQAGDPYYISKRKRDEWLARWKREAEKKAKVIAVMNAVEENQGSTESQKVEEASPPAVQQPTDPASPTVATTPEPVGADAGDKNAAKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPMCHDSDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 816 - protein, 909 aa, Ictidomys tridecemlineatus
MPSSGPGDTSSSAPEREEDRKEGEEQEEPRGKEERQEPSATARKVGRPGRKRKHPPVESSDTPKDSAATSKSLSMAQDSGPAELLPNGDLEKRSEPQPEEGSPAGGQKGGAPAEGEGAAESPPEASRAVENGCCAPKEGRGASAEEGKEQKETNIESMKMEGSRGRLRGGLGWESSLRQRPMPRLTFQAGDPYYISKRKRDEWLARWKREAEKKAKVIAVMNAVEENQGSGEAQKVEEASPPAVQQPTDPASPTVATTPEPVGADAGDKNATKSADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDTAKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRRDDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 817 - protein, 691 aa, Monodelphis domestica
  VARIANT 299, 394: Xaa = Any Amino Acid
MNVVEENQGPGEPQKVEEASPPILQQPTDDASPTVATTPEPVGADAGDKNTAKAAADEPEYEDGRDFGIGELVWGKLRGFSWWPGRIVSWWMTGRSRAAEGTRWVMWFGDGKFSVVCVEKLMPLSSFCSAFHQATYNKQPMYRKAIYEVLQVASSRTGKLFPACPENDESDTAKAVELQNKQMIEWALGGFQPSGPKGLEPPEEERNPYKEVYTDMWAPVEPEAAAYAPPPPAKKPRKSTAEKPKIKEIIDERTRERLVYEVRQKCRNIEDICISCGNLNVTLEHPLFIGGMCQNCKNXFLECAYQYDDDGYQSYCTICCGGREVLMCGNNNCCRCFCVECVDLLVGPGAAQAAIKEDPWNCYMCGHKGTYGLLRRRDDWPSCLQMFFANNHDXEFDPPKVYPPVPAEKRKPIRVLSLFDGIATELLVLKDLGIQVDRYIASEVCEDSITVGMVRHQGKIMYVGDVRNVTQKHIQEWGPFDLVIGGSPCNDLSIVNPARKGLYEGTGRFFFEFYHLLHEARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFLNEKEDILWCTEMERVFGFPVHYTDVSNMSRLARQRLLGRSWSVPVIRHLFAPLKEYFACV

SEQ ID NO: 818 - protein, 301 aa, Artificial Sequence
  Synthetic Construct
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 819 - protein, 421 aa, Mus musculus
MGSRETPSSCSKTLETLDLETSDSSSPDADSPLEEQWLKSSPALKEDSVDVVLEDCKEPLSPSSPPTGREMIRYEVKVNRRSIEDICLCCGTLQVYTRHPLFEGGLCAPCKDKFLESLFLYDDDGHQSYCTICCSGGTLFICESPDCTRCYCFECVDILVGPGTSERINAMACWVCFLCLPFSRSGLLQRRKRWRHQLKAFHDQEGAGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 820 - protein, 387 aa, Pan paniscus
MAAIPALDPEAEPSMDVILVGSSELSSSVSPRTGRDLIAYEVKANQRNIEDICICCGSLQVHTQHPLFEGGICAPCKDKSLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLKEYFKYFSTELTSSL

SEQ ID NO: 821 - protein, 422 aa, Rattus norvegicus
MGSRETPSSCSKTHETLNLETPESSSTDPDSPLEEQWPKSAPDLKEEDSMDMVLEDSKEPLTPSSPPTGREVIRYEVNVNQRNIEDICLCCGSLQVYAQHPLFEGGICAPCKDKFLETLFLYDEDGHQSYCTICCSGHTLFICESPDCTRCYCFECVDILVGPGTSERINAMACWVCFLCLPFSRSGLLQRRKKWRHQLKAFHDREGASPVEIYKTVSAWKRQPVRVLSLFGNIDKELKSLGFLESSSGSEGGTLKYVEDVTNVVRREVEKWGPFDLVYGSTQPLGYSCDRCPGWYMFQFHRILQYARPRQDSQQPFFWIFVDNLLLTEDDQETTVRFLQTEAVTLQDVRGRVLQNAMRVWSNIPGLKSKHADLTPKEEQSLQTQVRTRSKLAAQKVDSLVKYCLLPLREYFKYFSQNSLPL

SEQ ID NO: 822 - protein, 410 aa, Rhinolophus sinicus
MAISSPGTLSLEPLDSSDPEPARALDEESWQPPCEIILDLDAECSTDVILVGSSELSCPTSPGRRRDLIAYEVKVNQRDIEDLCICCGSFQVHTQHPLFEGGMCAPCKDKFLDGFFLYDDDGYQSCCSICCAGETLLVCENPDCTRCYCFDCVDALAGPGTAGTVQAMSHWVCFLCLPFSCCGLLRQRPKWRGRLKALYDQESESPLEMYKIVPVWKREPVRVLSLFGDIRKELTSLGFLEDGSGTGRLKHLDDVTNIVRRDVEHWGPFDLVYGCTPHPGQACDRPPGWHLLQFHRILQYARPRQGRSQPFFWMFVDNLLLSKDDRSVATRFLETDPVTIQDAVLVWSNIPAVRSRHSALVPQEELSLLAWDRQRAKSPTPGPAKLVKNCFLPLREYFKYFSVNSLPLYK

SEQ ID NO: 823 - protein, 493 aa, Equus caballus
MNQADGTWLVPQEPGWDVPGYMQPPPDPWAQRHLNPTGIKPWVTPSGQQTQLIKPGWTLSLETLDSWDPDVAGQLDEERWQPSSEIVGRPMAAAPVLDLEEEPSMDIILVDSSELSSPPSPGPSRDMCICCGSFQVHTQHPLFEGGMCAACKDKFLSCLFLYDDDGNQSYCSICCSGETLLICENPDCTRCYCFECVDTLVSPRTSEKVQAMSNWVCFLCLPFPRSGLLQRRRKWRGWLKAFYDQEAVRSRSAWGRRMRSGPHLVGFLWLLVAKCPSALESPLEMYKTVPVWKREPVRVLSLFGDIKKELTTLGFLENGSDPGRLKHLDDVTNTVRRDVEEWGPFDLVYGSTPPLGHACDHPPGWYLFQFHRVLQYARPRPGSPQAFFWMFVDNLVLTEDDRAVATRFLETDPVTIQDVCGRAVRNAVHVWSNIPAVKSRHSALFSQEESFLRAQDRQRAKPPARGPAKLVKNCFLPLREYFKYFSTEFTSSL

SEQ ID NO: 824 - protein, 417 aa, Ovis aries
MALSSPGTLNLETVDGSDPDPALLPDREQWPPPCEIVLDPEAEHSLDIILVGSSELSSPPSPGPRRDFIAYEVKVNQRDIEDVCICCGSLQVHTQHPLFEGGMCAPCKDKFLECLFLYDDDGYQSYCSICCAGETLLICENPDCTRCYCFECVDTLVGPGTSGKVHAMSYWVCFLCLPFPRSGLLQRRRKWRTWLKAFYDREAENPLEMYKTVPVWKREPIRVLSLFGDIKKELTSLGFLEDGSKPGRLKHLDDVTNVVRRDIDEWGPFDLTYGSTPALGHTCDHPPGWYVYQFHRILQYARPLPGSPQPFFWMFVDNLVLTEEDLDVATRFLETDPVTIQDVRGRTVQNAVRVWSNIPAVKSRHSALVSQEELSLLAQDRQRVKPLAQGPATLVKNCFLPLREYFKYFSTELTSSL

SEQ ID NO: 825 - protein, 562 aa, Bos Taurus
MGPGPSGCSKPGEGVSEVSSNSLGSGAGGHGGSVSSGWPGSFGRCLAAALEVSTRAPVEFWTFHCAGSFHSSPLPASNPERPGGGLRNHRRAQSPPAFKSSWERPRLDGIWETLGRQEHGVAEGPSAGGTQTEEVPRRTPGPGLKQDSRIPRLRDGGWWGTFSLSAVSPISWFGVPLSATLVLDPEPEHSLDIILVGSSELSSPPSPGPRRDFIAYEVKVNQRDIEDVCICCGSLQLHTQHPLFEGGMCAPCKDKFLECLFLYDDDGYQSYCSICCAGETLLICENPDCTRCYCFECVDTLVGPGTSGKVHAMSNWVCFLCLPFPRSGLLQRRRKWRTWLKAFYDREAESPLVMYKTVPVWKREPIRVLSLFGDIKKELTSLGFLEDGSKPGRLKHLDDVTNIVRRDIDEWGPFDLTYGSTPTLGHTCDHPPGWYVYQFHRILQYARPLPGSPQPFFWMFVDNLVLTEEDLDVATRFLETDPVTIQDVRGRTVQNAVHVWSNIPAVKSRHSALVSQEELSLLAQDRQRVKSPAQGPATLVKNCFLPLREYFKYFSTELTSSL

SEQ ID NO: 826 - protein, 416 aa, Orcinus orca
MALSSPGTLSLETLDGSDPDPAPLLEGEPCPQPCEIILDREAEHSTDIIPRSSEQSSPPSPRLRRDLIAYEVKVNQRDIEDMCICCGSFRVHMQHPLFEGGMCTPCKDKFLECLFLYDEDGYLSYCSICCAGETLLICESPDCTRCYCFECIDSLVGPGTSGKVQAMSNWVCFLCLPFPHSGLLQRRKKWRGWLKAFCDREAESPLEMYKTVPVWKREPIRVLSLFGDIKKELMSLGFLEHGSEPGKLKHLDDVTNVVRRDVEAWGPFDLAYGSTPPLGHACSQPPAWYLFQFHRILRYARPRPGSPQPCFWMFVDNLVLTQDDRVVATRFLETEPVTIQDVRGCTIRNAVHVWSNVPAVKCRHSALDPQEELSLLARDRQRAKPPTQGPATLVKNCFLPLREYFKYFSTELTSSL

SEQ ID NO: 827 - protein, 491 aa, Ictidomys tridecemlineatus
MRGGGRILGASARRLQLVRWRPSLGQLQVASEAPHPSPYPRRIRPEPTPHTYSQLPTALDLGPGQSPTYWEALWPDLMALSRSGTLTPDSLGSDPDPDRLLDGAQWQQRFLDLEAEHSMDVILVGSSGRSSPSSVQLGRDLIAYEVTVNQRNMEDICLCCGSFQVHTQHPLFEGGICAPCKDRFLEALFQYDEDGYQSSCSICGSGETLLICENPDCTRCYCLECVDTLVGPGTAGRIHAMSSWVCFLCLPFSRSGLLQRRRKWRERLKAFQDREVASPQEIYKTLPAWKREPVRVLSLFGDIGKELTSLGFLEPGSEAGRLRHLEDVTDIVRRDVEEWGPFDLVYGSTPALGHACDHSPGWYLFQFHRLLQYARPRPGSPQAFFWMFVDNLQLTGEEQAIAARFLETEPVILQDVRGSALQNAVRVWTNIPAVKSRHSALASEEELLLLAQDGQRGTLPAQGPSALVKNCFLPLREYFKYFSQNALPLYK

SEQ ID NO: 828 - protein, 346 aa, Monodelphis domestica
MLKSMAHSPPETLSDVILVESETDVVEHLEEDGQQCEIVVVLEEERSTEVISLDSSERSFGSSPRPSKDLIAYEVMVNQRNIEDICICCGSLQIHTQHPLFDGGMCFPCKDNFLESFFLYDEDGYQSFCTICCSGEILLTCENPSCSRCYCFECVDALVNPGSSAKFQAMSNWICFLCLPLISENGLLKKRRKWREHLKDFYDRETHRPLEMYKTVPAWKRKPIQVLSLFGDIETELVKFGFLDNSSDNGMLKYLDDVTDVVRKDVEEWGPFDLIYGSTPAFGQIFKHPPVFQFVQIHEENSSYHSPSLGTEVMNNGCKILHTVKNGWILPIPFIMEMLNVRKVIK

SEQ ID NO: 829 - protein, 215 aa, Artificial Sequence
  Synthetic Construct
MGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 830 - protein, 2176 aa, Arabidopsis thaliana
MEPTDSTNEQLGDTKTAAVKEESRSFLGIDLNEIPTGATLGGGCTAGQDDDGEYEPVEVVRSIHDNPDPAPGAPAEVPEPDRDASCGACGRPESIELVVVCDACERGFHMSCVNDGVEAAPSADWMCSDCRTGGERSKLWPLGVKSKLILDMNASPPSDAEGYGAEETSDSRKHMLASSSCIGNSFDYAMMHSSFSSLGRGHASLEASGLMSRNTKMSMDALGSHNLGFGFPLNLNNSSLPMRFPSLDPSELFLQNLRHFISERHGVLEDGWRVEFRQPLNGYQLCAVYCAPNGKTFSSIQEVACYLGLAINGNYSCMDAEIRNENSLLQERLHTPKRRKTSRWPNNGFPEQKGSSVSAQLRRFPFNGQTMSPFAVKSGTHFQAGGSLSSGNNGCGCEEAKNGCPMQFEDFFVLSLGRIDIRQSYHNVNVIYPIGYKSCWHDKITGSLFTCEVSDGNSGPIFKVTRSPCSKSFIPAGSTVFSCPKIDEMVEQNSDKLSNRRDSTQERDDDASVEILLSEHCPPLGDDILSCLREKSFSKTVNSLRSEVDSSRVDFDKNLSYDQDHGVEIGDIVVEEDSLSDAWKKVSQKLVDACSIVLKQKGTLNFLCKHVDRETSEINWDTMNEKDNVILSLSKFCCSLAPCSVTCGEKDKSEFAAVVDALSRWLDQNRFGLDADFVQEMIEHMPGAESCTNYRTLKSRSSSSVPITVAEGALVVKPKGGENVKDEVFGEISRKAKKPKLNGGHGVRNLHPPPGRPMCLRLPPGLVGDFLQVSEVFWRFHEILGFEEAFSPENLEQELINPVFDGLFLDKPGKDDKRSEINFTDKDSTATKLFSLFDESRQPFPAKNTSASELKEKKAGDSSDFKISDSSRGSCVGALLTRAHISLLQVLICELQSKVAAFVDPNFDSGESRSRRGRKKDDSTLSAKRNKLHMLPVNEFTWPELARRYILSLLSMDGNLESAEIAARESGKVFRCLQGDGGLLCGSLTGVAGMEADSMLLAEAIKKISGSLTSENDVLSVEDDDSDGLDATETNTCSGDIPEWAQVLEPVKKLPTNVGTRIRKCVYEALERNPPEWAKKILEHSISKEIYKGNASGPTKKAVLSLLADIRGGDLVQRSIKGTKKRTYISVSDVIMKKCRAVLRGVAAADEDKVLCTLLGRKLLNSSDNDDDGLLGSPAMVSRPLDFRTIDLRLAAGAYDGSTEAFLEDVLELWSSIRVMYADQPDCVDLVATLSEKFKSLYEAEVVPLVQKLKDYRKLECLSAEMKKEIKDIVVSVNKLPKAPWDEGVCKVCGVDKDDDSVLLCDTCDAEYHTYCLNPPLIRIPDGNWYCPSCVIAKRMAQEALESYKLVRRRKGRKYQGELTRASMELTAHLADVMEEKDYWEFSAEERILLLKLLCDELLSSSLVHQHLEQCAEAIIEMQQKLRSLSSEWKNAKMRQEFLTAKLAKVEPSILKEVGEPHNSSYFADQMGCDPQPQEGVGDGVTRDDETSSTAYLNKNQGKSPLETDTQPGESHVNFGESKISSPETISSPGRHELPIADTSPLVTDNLPEKDTSETLLKSVGRNHETHSPNSNAVELPTAHDASSQASQELQACQQDLSATSNEIQNLQQSIRSIESQLLKQSIRRDFLGTDASGRLYWGCCFPDENPRILVDGSISLQKPVQADLIGSKVPSPFLHTVDHGRLRLSPWTYYETETEISELVQWLHDDDLKERDLRESILWWKRLRYGDVQKEKKQAQNLSAPVFATGLETKAAMSMEKRYGPCIKLEMETLKKRGKKTKVAEREKLCRCECLESILPSMIHCLICHKTFASDDEFEDHTESKCIPYSLATEEGKDISDSSKAKESLKSDYLNVKSSAGKDVAEISNVSELDSGLIRYQEEESISPYHFEEICSKFVTKDCNRDLVKEIGLISSNGIPTFLPSSSTHLNDSVLISAKSNKPDGGDSGDQVIFAGPETNVEGLNSESNMSFDRSVTDSHGGPLDKPSGLGFGFSEQKNKKSSGSGLKSCCVVPQAALKRVTGKALPGFRFLKTNLLDMDVALPEEALRPSKSHPNRRRAWRVFVKSSQSIYELVQATIVVEDMIKTEYLKNEWWYWSSLSAAAKISTLSALSVRIFSLDAAIIYDKPITPSNPIDETKPIISLPDQKSQPVSDSQERSSRVRRSGKKRKEPEGS

SEQ ID NO: 831 - protein, 2183 aa, Arabidopsis lyrata
MELTDSTTEQLGDTRTAALNEENRSFLGIDLNEIPTGPTLGGGCTGGQEDDGEYEPVEVVRSIHDNPDPAPGAPAEVPEPDRDASCAACGRPESMELVVVCDACERGFHLSCVNDGVEAAPSADWMCSDCVTGGERSKLWPLGVKSKLILDMNASPPSDAEGYGGEETSDSRKHMLASSSFMGNSFDYAMMHSNFSSPGRGLASLEASGLIARNTKMSMDALATHNLGFGFPLSLNNSSLPMRFPSLDPSELFLQNLRHFISERHGVLEDGWRVEFKQPLNGYQLCAVYCAPNGKTFSSIQDVACYLGLAVNGNYSCMDADIRNESSLLQERLHMPKRRKTSRWPNNGFPEQKGSSVSAQLRRFPFNGQTMFPFVVKSGTHLQAGDSLNSGNNGCGCEEANNGLPMQYEDFFVLSLGRIDIRQSYHNVNVIYPIGYKSCWHDKITGSLFTCEVSDGTSGPVFKVTRSPCSKSFIPVGSTVFSCPKIDEMVEQNIDKQSDRRDSTLEHDDDANIETLLSDHSPPLGDDILSCLREKNFSKTFNCLRSEVGSSQVESDKVLSYNQDRGVEIGEIVVEEDSLSAAWNKVSQKLVDACSIVMKQKGTFNFLCKHVDRETREINWDTMNEKDNVFLSLSRFCCTLGPHSVTCGEKDKSEIATLVDALSRWLDQNRFGLDADFVQEMIEHMPGAESCTNYRTLKSRSSSSVPVTVAEGALVVKPKGGENVKEEVFGEISRKSKKPKLNGDFGVRNLHPPPGRPMCLRLPPGLVGDFLQVSEVFWRFHEILGFEEAFSSEKLEQELINPVFDGLFLDKPGKDDKRSEMNFTNKDCSGTEFFSLFDESRQPFPAKNTSASVLKETKAEDSSDFAISYSSHGPCVGALLTRTHISLLQVLICELQSKVAAFVDPNFDSGESRSRRGRKKDDSTLSAKRNKLHMLPVNEFTWPELARRYILSLLSMDGNLESAEISARESGKVFRCLQGDGGLLCGSLTGVAGMEADSMLLAEAIKKISGSLTSEHDVLSVEDDDSDGLDATETNTCNGDIPEWAQVLEPVKKLPTNVGTRIRKCVYEALERNPPEWAKKILEHSISKEVYKGNASGPTKKAVLSLLADVRGGDLVQRSVKGTKKRTSIGVSDVIMKKCRAVLRGVAAADEDKVFCTLLGRKLLNSSDNDDDGLLGTPAMVSRPLDFRTIDLRLAAGAYDGSTEAFLEDVLELWSSIRVMYADQPDYVELVATLSEKFKSLYEAEVLPLVQKLMEYRKLECLSAEMKKEIKDIVVSVNKLPKAPWDEGVCKVCGVDKDDDSVLLCDTCDAEYHTYCLNPPLIRIPEGNWYCPSCVIAKRMAQEALESYKLVRRRKGRKYQGQLTRTSMEMTAHLADVMEEKDYWEFSAEERILLLKLLCDELLSSSLVHQHLEQCAEAIIEMQQKLRSLSSEWKNAKMRQEFLTAKLAKVEPSILKEVGEPHNSGHFADQMGCDQRPQEGVGDGVTHDDSSTAYLNKNKGKAPLETDSQPGEFQDSQPGESHVNFESKISSPETISSPGRHEKPIADTSPHVTDNPSFEKYTSETLHKSVGRNHETHSLNSNAVEIPTAHDASSQASQELQACLQDLNATSHEIHNLQQSIRSIESQLLKQSIRRDFLGNDASGRLYWGCCFPDENPRILVDGSISLQKPVQADLMGSKVPSPFLHAVDHGRLRLSPWTYYETETEISELVQWLHDDDLKERDLRESILCWKRLRFGDVQKEKKQAQNLSAPILARGLETKAAMSMEKKYGPCIKLETETLKKRGKKTKVSQREKLCRCECLESILPSMIHCLICHKTFASDDEFEEHTESKCIPYSLATEESKEISDSSKAKESLKSDYLNVKSSAGKAVGEISNVSELDSGLIRYQEEESISPYHFEEICSKFVTKDSNRDLVKEIGLIGSNGIPTFLPASSTHHNDSVLINANPNKLDGGDSGDQVIFAGPETNVEGLNSESNLSFDGSVTDNHGGPLNKLTGLGFGFSEQKNKKSSGSGLKSCCVVPQAALKRITGKALPVFRFLKTNLLDMDVALPEEALRPSKSHPDRRRAWRVFVKSAQSIYELVQATFVVEDMIKTEYLKNEWWYWSSLSAAAKISTLSALSVRIFSLDAAIIYDKPITPSDHNDETKPIISSPDQKSQPVSDSQEKSSRVNRRSGKKRKEPEGS

SEQ ID NO: 832 - protein, 2208 aa, Cucumis sativus
MELADSSDEHPQLNHLPNPTDSTTRSATGTGIGIDLNEIPSPSSFSETLSDSFDVVRTFHDNPPPSDGDPAHVPRGVRGSVCGLCGQPEVRGHVVVCDGCERGFHLACTGMRGGHALNFEDWVCGECFTTGVKSKRWPLGVKSKQLLDINASPPSDGDAYGEDGEELPGIRKHTAVDNSLRGTPFCSSAKYRNLLHSGNGYGHQRAPDTVKNKVKMGLEDVLQQNQVIGRSLDVDLGCPLGSCRSSRGTSVKLSSQNTSEVFLQALREFISERNGVLEEGWCVEIKQSVDSSELYAIYRAPDGKTFGSVYEVACHLGLMSSMQPKARRQGSSHLSGKSYIPKRRKPTKFSVANGFVDNNETLINDRCKGVLCDRQSPSGVTVVNLENSEEAVAEENGGSISSQCYEGFPLQFEDFFVLSLGEIDARPSYHEVTRVYPVGFRSCWHDKVTGSIFINEVLDGGDSGPLFKVRRCPCSAFPIPVGSTVLSKGKSENFSIEQQKEDGLINNSNDDNLQTIFSDVCPPNEDDILSCLGVCSDRDFNVHMQNGLHHEAGSIGKSGDLSDYQYLKDEIGEISVEDTSSSIAWKRMSYDLIKACSELCNQKNTFRLCCNHVGNEQSLLGHCRTRDNSELNSRLAKFCGFPNSAFGQSVVEVENNQSSLPDELEKWLDQDRFGLDMEFVQEILEKIPRIQSCSSYQFVNKRIDSTTLPAVENGVLEVQKFDGEDCKEDEPLNFLFRRFKKTKLAGDGNANYKNPPPGKLLCSRVPPELTGDVYQVWDFLSRFHENLGLKEALSLEELEEDLFNLRGGGVDILQNSENEFKKDPLLNSLNTEFSNDRVSSKFNANGDPHAFIQMETRAMKEVSEVNLASSTDSRCVGAALTKAHTSLLRVLITELQSKVAALVDPNFDSGESKPKRGRKKDADSASSIRKMKLNLLPLNELTWPELAHRFILAVLSMNGNLESAEVTARESGRVFRCLQGDGGVLCGSLTGVAGMEADAFLLAEATKQIFGTLNREKHIITIEEETPDTTGGGCEKVLVTDGNMPEWAQVLEPVRKLPTNVGTRIRRCVYDALERNPPDWAKKILEHSISKEVYKGNASGPTKKAVLSILADICGDSLPPKVEKRRKRITTISISDIVMKQCRTVLRRAAAADDAKVFCNLLGRKLMASSDNDDEGLLGPPGMVSRPLDFRTIDLRLASGSYDGSHEAFLEDVQELWNNLRYAYGDQPDLVELVETLSENFERLYENEVLSLIEKLKEFSKLESLSAETKVEVDGFLVSLNEIPKAPWDEGVCKVCGIDKDDDSVLLCDTCDAEYHTYCLNPPLARIPEGNWYCPSCVMGTRMVEDPSEHTKNHIINLHKGKKFRGEVTRDFLNKLANLAAALEEKEYWEFSVDERLFLLKYLCDELLSSALIRQHLEQCVEALAELQQKLRSCFIEWKNLKCREEVVAARAAKLDTTMLSAVREGQGSCDGARLGASDQYSSLTSLENKCHNHASFQEQMSSAHDVTDNNDAGGNVLSSSGSQNSGKPVKFNEPSLSGLPQEVDGSDQSNMETEISILPSGKQYFTPCDANGVPVAPQVPPPNESQAYHSELDSIKKDILQVQDSIASTELELLKISVRREFLGSDAAGRLYWASVMSNGLPQIISSGSSVHIGSESRDRVVKGRFFKNYTSTSNANSSTLNSNMYSSLLHLPKDFIGNSPCISYQTEADILELIDWLKDSDPKERELKESILQWLKPKLQTSSRSNNQSPEEQLKDSSSSSDVEKLECSGFLVNRASALLESKYGPFLEFVTPDDLNRWLDKARLAEDEKMFRCVCMEPVWPSRYHCLSCHRSFSTDVELEEHDNGQCSSLPASCDGIKEVGDSSKSKCNIKFESKQEESSSMVIAETSRGYFNHSMGLIKYQNDGMMCPYDFELICSKFLTKDSNKDLIKEIGLISSNGVPSFLSSVSPYIMESTLNVIDLKKDSSTPEDGTLLSEWPSLENIILENGCHQSSSIDSSIQKPAGNEISAPKTKRLAAGCLEPKSKKICMDNRFSEFGIGRCFVIPQSSQRPLVGKILQVVRGLKMNLLDMDAALPDEALKPSKLHIERRWAWRAFVKSAGTIYEMVQATIALEDMIRTEYLKNEWWYWSSLSAAAKISTVSSLALRIFSLDAAIIYEKISPNQDSNDYLDTTSSIPEQKLGGVDLTEKPRTSSRKSGKKRKEPEG

SEQ ID NO: 833 - protein, 2240 aa, Vitis vinifera
MMGLGDSSGEYRDSKSETRSVLGIDLNEIPSSSFVEASHDVPDAYAVVRSFHGELSPAAGAAAGLPGEGWGSVCAVCGAPEVGAQVLVCDGCERGFHLVCVGMPGRQAGMLEEWVCGECVRSGVGSKRWPLGSKRRLLDINASPPSEGEGEELPDSRKHSPGDNSFGGNSFGAPETYSNFRCAGNGFGFPKASGILTHAVKLGLEDILHHTNRSFEEVDSGFPLGRLRSSNNTACRLPPQEPSEMLLQALKEFISERHGVLEEGWRVELKQSVRAGELCPVFCAPDGRIFESMSEVAVYLGLTSNCNSVDTEIRSDGSASLKKRSHLSKRRKSTRLSIANSSAENKDALLTDFCKDISSDVQSMELCASNLGNSVKVTEAAPEENGGTGLQQHNNGLPVQFEDFFVLSLGEVDVRPSYHDVNQLWPVGYKSCWHDKLTGSLFMCDVSDGGDSGPIFKVKRCACSAIPLPNGSTVLCRPNLGQSNGQDKEKSNDMISLSMDYDEDGSLQTLLADPSPPMENDILSCIRSSSNGSCCVQTLNSLLLEDNSLHESSGEFLSDHSRLKDEIGEFSLQGRSSSSVWNLVSQKFIDACCETYKRTGSLRFFCEHVKLGASTLPWDIMDESSKGSYTSLDKFCSSPGSVCMPSVIQGENELQTQCEVLAKWLDQDRFGLDVEFVQEMLEQLPGVCACSQYKLLNNRSYHSTLLTVGNGLLLAETENGVQSKGEEALDCLFGGSKRARKYTVGDPLMDDFCPPPGNPLGSRLPPDLVGDVIQVWESLWRFYEILGLKEPFSIEELEEELICPWSDDLNLLEKFGTETQENRDITPTRPSGASGHIPSSSTDSGPEVSTGNPHAFIQMETGQKKEAAQAKLASVTYSRCSGVTLTKAHNSLLKVLVSELQFKVAALVDPNFDSGESKSRRGRKKDADNAIPTKKTKLNMLPINELTWPELARRYILCVLSMDGNLDSAEITIRESGKVFRCLQGDGGVLCDSLTGVAGMQADALLFAEARKQIFGSLNREDDILTIEEKGSDATGDHDRIVVNDGNIPEWAQVLEPVRKLPTNVGTRIRKCIYEALEKDPPEWAKKILAHSISKEVYKGNASGPTKKAVLSVLGIVHDEGLKSKPDKERKRKRVISIPDIIMKQCRITLRRGAAADDAKVFCTLLGSKLINSIDNDDEGLLGTPAMVSRPLDFRTIDLRLAVGAYGGSWETFLEDVRELWNNIHTAYADQPDSVELARTLSQNFESMFEKEVLPLVQKFTEYAKSECLSAETEKEIDDFLVSASEIPKAPWDEGVCKVCGIDKDDDSVLLCDMCDAEYHTYCLNPPLARIPEGNWYCPSCVAGISMVDVSEHTHVIAQRQGKNCQGDFTHAYLESLAHLAAAMEEKEYWELSVDQRTFLFKFLCDELLNTALIRQHLEQCAESSAELQQKLRSISVEWKNLKLKEENLAARAPKVDSGMIYVAGEVGTEGGLSSALTNNGKCIAKPHTLSDRPKDFGILSNDQLQVEGGSEGIRPNGLDKHPSSNCSEGNCTLKPIDNEGQLKEVHAVVDETQVSVDHFPHMVYQGNGSSCRPNELHLQNPLQQEMDGLGTEFNLQVNMCENMEKNDLQGLHHPSDIRIVHVAEHDSELNSIKNDISDLQDSMASIESQLLKLSVRREFLGSDSAGRLYWILAKPGWHPWVLVDGSMALQKKEKMRYLKNPGDSSVQKNSTSLSMDILSTLGGSNASCPFLYRPNASISICSQWVSYQSGEEIDALIGWLKDADPREKELKESILHLHKLRFRDWKLTGDPDQVDSQTTLSRFPNSENAFSDGLLTKAGILLGKKYGPWFEPEIADSSKKWDLRSKVTNESKMYRCECLEPIWSSRHHCPSCHRTFFTDIQLEEHNDGSCRSGPPTSEKSKENSSHLKGKGTMKSKISREESTGDIDMVEIPKGGCSQPRSRLIKFQNEGLVCPYDFEEICSKFVTKNSNKELVQEIGLIGSKGVPSFVSSRPPYISDATLLLVPSGELKATGDMMLAQGNRIPAGGSGSFSDNSSRDSAANETSAASRTDKSALEQKDKKYSLNNNGPEMEVGRCCVIPQSSLRPLVGKVYQILRQLKINLLDMDAALPEEALKPSRADLEKRLAWRAFVKSAETIFEMVQATIMLEDMIKTEYLMNGWWYWSSLSAAAKTSTVSSLALRIYSLDAAIAYEKISSNLDLTDSPKPSSKPDPKPVPNLDTMEKSKLGRKQNKRRKESEG

SEQ ID NO: 834 - protein, 2161 aa, Medicago truncatula
MAELTDSTAAGNNLPPPQQPPQQIDTRSILCIDLNEIPSPSSSFVETLPDFTVDIVRTYHENPAPPPGGPAPLPGGVTSCAVCSKSGAGGLVCDGCERSFHLACAGVRGGRIGAASIGEWVCGECLAGGVKSKRWPLGVKSKQLLDINASPPSDVDGEELHESRKHAMGDQSFAANQFGASVTYSTFNNGSVVGFQRASGAVTRPVRVGFEDILNHTQSMARSFEEVPSQTHGPNELILQALRDFISERHGVLVEGWRVDLRPSMAGSDMYAVYCAPDGKIFDSVYEVANYLGLPSGYNSIESEVRNEMSLSSGGPHLSRKRKSSRTLAANGFAEKQGTFVNSNYKDCSSDGLSMEHVNAQGTALKATEIRRKENGHSDPHQFADELPLQFKDFSVLSLGKVDGRPSYYDVNLIFPVGYKSCWHDKITGSLFTCEVLDGGDSGPIFRIKRCSCSEFPIPDGSTILSMHNRCQFASETNEGQRETNDSMDLDGDESIQMMLLEPCAPTEDDILSCVVSCSSEAYVSEGLRPVVGSIQYNTGYSFSDTMNFCDEIGQILVEERSPFSAWRVISQKLVNACKDICKKNGTFKFYCKHVESEMGLHRWDLRNSESDTHFTSLDKFCGSPGSVSIPDTIYADSDVKDLYELLEKWLEQDRFGLDAEFVQEILEPLLGVQDCLQYERLGSRNNSSSLPTVENGYLVVDCKGQSKYQDEVIQGLYRRPKKARLTEYVKENRCPPPGKPLCSRAPTELIGDIFQVWDLLERFNEILDLKEPLFLEELEKELINPWFNELDFPEKSDRGMGGSSRGGDGDCRLISEACPSGSTGASSYVRCFGASLTKAHSSLLRVLIGELQSKVAALVDPNSEPGEARTRRGRRKDMDSAVPRTKINMLPINELTWPELARRYILAFLSMDGNLESAEITARESGKVFRCLRGDGGLLCGSLPGVVGMEADALLLAEATKKIFGSLSREKDVLILEEEESDANGSSEAQLANDGNIPEWAQVLEPVRKLPTNVGTRIRRCVHAALEKNPPDWAREILEHSVSKTVYKGNASGPTKKAVVALLDDVTGGVQQNPNKGRKKKFFISISDIIMKQCRIVLRRAAALDDSKVFCNLLGRKLTNSSDNDDEGLLGTPAMVARPLDFRTIDLRLASGAYGGSHEAFLEDVRELWSNVRVAFGDQPDLVELSEKLSQNFESLYNEEVVTYVQKFTDYAEVGCINAEMKKEVQAFIASSNEIPKAPWDEGVCKICGIDRDDDSVLLCDTCDAEYHKYCLNPPLARIPEGNWYCPSCIGGKHATQDLTERAQLTGKRRSKKFQGQVNCLYLDALTHLSSVIEEKEYWEYSVGERTLLLKFLCDELLNSSLIRQQLEQCSELSAELNQKLRGLSVEWKNLKIKEDVLSTKAAKFGTLSQCTTGEVGLKEGFTSLFSNTSKCLVKPHATTTNPSGLGVFDDSLPSEEIPKEKCRFNSVDKSISVTHSNSDSQNMNSIGQLKTVPVAVEFQCTDKSPKSFPFSNHMPQEINGYSEGQCVPVEVSQNAVNESEPYHLELNAVKRNISLLHESINSVGSQLLKLPVRRELLGIDSIGRLYWALATLRGRSRIVVDASAVVQHGRGLSVSKDSGEKLSALQHCKLSEKDNYKMLGLMKDCSPLMSQPLNALANSSPWIVYETDSEIEELLGWLDDYDPKEKELRDSIMLGPKYRSQEFINAHTEGQVEDQGPVYLPRNTAPNSLVTKATSLLEKNYGPFFDLDTAEGLKNQNKKARTTNDEKLYRCECLEPIWPSRKHCLYCHKTFLSDVEFEGHNGGKCKAGLMALGRNKDKNGSSKGRKNLKCDTSHEKSRADTETDGTSINGCSSLNSRLTKFSNENPSCPFNFEDTCAKFVTNDSNKELVREIGLIGSDGAPSFVPSVSPFVSDYTQALTIKDVGVVGGASKASESQVSQENTDGAGTCHDHKSGKSTESLAANRSNKAGNSNKSSLGEQRDGKLSICSPASDKGVDGCCVVPLSSLRPLVGKISHILKQLKINLLDMDAALPKVALRPSKAQLDRRQAWRAFVKSAMTIYEMIQAIITLEDMIKTEFLKNDWWYWSSFSAAAKSSTLPSLALRIYSLDSAIMYEKMPNSSLAESSDPPAVAEPKPVITVDADKSKGSRKSNRKRKELDG

SEQ ID NO: 835 - protein, 2208 aa, Ricinus communis
MELTDSSDITTRSPLFIDLNEIPSSSTSSPPSIARPDPESNKRPKPDEFDSLDVVRSFHENQDPATGIAAGLPEEEKLLVCGACGKPEAREKDEVVVCDGCERGFHLLCAGMHGKEEVMKFLDWICGDCVNNGIKSKRWPLGVNKSKKMILDINASPPSDCDGDGDGDEERAYLRKHALGDNSFSGNTFGAPVAYSNRLYVGNGFGPFDFRKASGLMMKAFKVGVEDILHHAQTVDRSLEEIDLGFPLGRFRSSNSTANKLPSRSPNEILLQGLREFISERHGILDEGWHVELKNSVSGCEVFVAYCSPDGKTFGSMAEVACYLGLTPSTRSDGSPSLQERLHLPKKRKTKRFSLANGYAETKQALINGYHKGLLSNGQSIEIGDSKFGKVTEANMEEEDIAKSLPSDEGLPLQFEDFFVISLGKIDGRPSYHGPQLIWPVGYRSCWHDRVTGSLFICEVLDGGDSGPIFKVRRFSCSSIPIPVGSTILYRRNPYQFAGQNSKEYNDVINYDMDRDNDGSIEMILADSSPPTEDDIMTCLSYTSKKVCDVRTSDCLQRSSLHNRCGDLSSYNLGSSTWDIEDKRSIISFASLAKFCSSPSLVGIPFEYQVEVDNLATALSKWLDQDRFGLDTDFVQEVIEQLPGVDACSKYEFLANRSNYSVSLTVGNGLLSAKRKDAAELDESFQRCKKPRLGKDHETDDRYLPPGRLLCSKIPPILVGDLYQVWELLWRFHEILGLEEPWSLRELEEELVNPWFDCASLSKNLQRKVSGSQVIHIDKADGTSGPISSPCQEPLKAVSEDTTHVFIQVEKGGTNESVQYGFASGTQSKCCDVTLTEVHGSLLSVLIRELQAKVAVLVDPNFDSGELKSKRGRKKDVDSSTLIRRSKCNTLPINALTWPELARRYILAVLSMEGNLDSTEITARESGKVFRCLQGDGGVLCGSLSGVAGMEADALLLAEATRQIYGSLMRENDVLIIEDEVTDASDSCEKNSVKDGNIPEWAQMLEPVRKLPTNVGTRIRKCVYLALEKCPPEWAKKRLENSISKEVYKGNASGPTKKAVLSVLADVLGEGLSQKSNNRNKRKITVPVSDIIMKQCRIILRHAAAADDAKVFCTLLGRNLINSCDHDDEGLLGYPAMVSRPLDFRTIDLRLAVGAYGGSHESFLEDVRELWNNVRTAFRDQPDVIELVETLAQNFESLYEKEVVTLVQKFEEFAKLDRLSAETKKDLDIVLASTNEIPKAPWDEGVCKVCGFDKDDDSVLLCDTCDAEYHTYCLNPPLARIPEGNWYCPSCVSVRMVQEASVSTQVIGQNSCKKYQGEMTRIYLETLVHLASAMEEKDYWDFGVDERTFLLKFLCDELLNSALVRQHLEQCMESTAEVQQKLRTLYAEWKNLKSKEEFMALKSAKMGTGASGEVKEGLVSALKDQGKSVGQPPVLGDKPSDCCAPSDDVSAVDGSPEGNGINGFDKHPSEINYEKKPSHDSQNIDSTNNHGPVKDMHDAMEGSNDPSKENSKPLGPSQLPLSNHSTEIDQMDEAPCEGSLQTYMERDSSTLQPPSDHPGFSLSSDMNALVVLNLPSVTMNESQAYHTDVSAIKDDILRLQNLISSMESQLSKQSLRREFLGSDSRGHLYWASATPNGHPQIVVDRSLTFQHRKISHHRLGNSSVLQHSSSSGIDACLNLEGSRACFPFLFNPNGTLSMSSAWVSYETDAEIEELIGWLGNNNQKEIELKESIMQWLKLRFQESQRIRDPVQEECRAGLSTIRNNDQTAFSNCLTKATLLLEKNYGAFVELDTSDMLKKRGKKARGTNEEKTYRCDCLELIWPSRNHCYSCHRTSSNDVEFEGHSDGRCSSVPQSREKSEETNDSLKGRGNVKAEVTWKEKKSEIDKLHSSMGGLSELRARLIKFQNEGINCPYDLLDICSKFVTEDSNKELVQDIGLIGSNGIPPFVTSISPYLSDSISVLISPENNTRIPGDECNVDERQVFPQGNWNENRAVLQSSSDNSTRKTSINEIGEVLKTNKPPLGCLQRRGKKSSLGKCFPEMGPGCCCVVPESSLMPLVGKVSSILRQLKINLLDMEAALPEEALRPAKGQLGRRWAWRAYVKSAESIYQMVRATIMLEEMIKTEYLRNEWWYWSSLSAAAKTSTVASLALRIYSLDACIVYEKNSNSDPSVNLKLSSLVNQKPVNDMDLVEKCRVTRKSNKKRKEPEG

SEQ ID NO: 836 - protein, 2202 aa, Glycine max
MIMELSDSTGGDRNLNAPPPLPPPHNNHNQDARSGLGIDLNEIPSPSSSFPETLPGSVTVDVVRSYHDNPAPPPGGPAALPRSGSSPCAACAKPSPAAGSHHQLVVCDGCERGFHLACAGIRGGGRQAASLDEWVCGECVAAGVKSKRWPLGVKQLLDINAPPPSDAEGDGGDDEVQVSRKHALGDNSFAANPFGALVTNSNFNNGNANGFEKASEVVTHAVRVGFEDILNHTQSITRSFEEALRDFVSERRGVLEEGWRVEFRQSVSNSELYAVYCAPDGKIFDSVYEVACYLGLTSGYNSIESELRSERSLPSLGGPPSRKRKSTRTTVANGSMENRGTSTNSNCKDPPCDGLNVECASARGNIPKPSEIGRKEDCHSCSQQSADGLPLQFKDFFVLSLGKVDGRPSYYDVNLIYPVGYKSCWHDKITGSLFTCEVLEGGDSGPIFRIRRCSCSEFPVPVGSTILSMSKLCQVVSQTNEGERKTNANMDLDYDEGLQMMLLDSCLPTENDILSCFPSCSIESRDMSDVLHPITSSVQDNASNSLADNLGFNGLGEILVEERSSFSAWRVISQKLVNACKDILKLKGTLKFYCNHVDKWDLRNGKSDTYCTSLDKFCGSLGSVGIPDVIYSDNDLEGIYVALGKWLEQDRFGLDVEFVQEVLEQLPSVQDSLQYELLNNRNNSSSLPTVENGFLVVEWRDGSKYQEEAVQALYGRSKKVTEKSIKESCHPPLGKPLCSRAPGELIGDIFQAWELLKRFHEILDLKEPLTLDELEKELINPWFDGSNFLEKSERDMDESQVFISLGADGNGRPLLSPRCEVDPSVSIESSHAFIHVETEAMKETAQVKLASFTYARCFGVALTKAHKSLLRVLIGELLSKVAALVDPNSEPGESRTRRGRRKDMDSAVPAKRTKLNMLPINELTWPELARRYMLAFLSMDGNLESAEITARESAKVFRCLRGDGGLLCGSLTGVAGMEADAQLLAEATKTIFGSLSRENDILTMEEEESNAKGAPEIFLANDGNVPEWAQMLEPVRKLPTNVGTRIRKCVYEALEKNPPEWAREILEHSISKEVYKGNASGPTKKAVLSVLVKVGGEGLQSNPNKSQKKKIVISISDIIMKQCRIVLRRAAAADDSKVFCNLLGRKLINSSDNDDEGLLGSPAMVARPLDFRTIDLRLATGAYGGSHEAFLEDVRELWNNVRVAFGDQPDLVELAEKLTQNFESLYNEEVVTYVQRFVEYAKLECLSAEMRKEVGDFIESTNEIPKAPWDEGVCKVCGIDRDDDSVLLCDTCDAEYHTYCLNPPLARIPEGNWYCPSCVVGKHATQNVTERTQVIGKRQSKKFQGEVNSLYLESLAHLSAAIEEKEYWEYSVGERTFLLKFLCDELLNSSLIHQHLEQCAELSAELHQKLRAHSAEWKSLKTREDILSTKAAKIDTFSLNTAGEVGLKEGFASLLSNTGKCLVQPHTAVDNPSNFGVFVDSLPSEEVTKDKYRFDSVDKSISVTNSDSDSQNMNSIDVEGQFRNVSGAVESQCTDKSPKSFPLPNHMPQETNGAGGASLVQGKNQKCEGKDIPTPVSYQQGMPVDVPQISVNESEPYHLELIAIKRDISLLQDSITSVASQLLKLSVRRECLGIDSIGRLYWASALPGGRSRIVVDASAALLHGRGMTFSRDYVEKFSVLQHCALSDKDSSLMSQPSNPLGNSSPWIAYETDVEIEELLGWLDDSDPKERELKDSIMLGPKSRFQQFINAQTEDRAKDQGNVSMPRNREKTVSNSLVTKATSLLEKKFGPFVEWDNSEVLKKQNRKTRTTNDEKLYRCECLEPILPSRKHCTHCHKTVASDIEFDGHNDGKCNAGLLAIEKNKDKNGSSKGRGNLKCDTLHEKFRADAETALTSVSGSSKLSSRLIKFSNEESTCPFNFEDICSKFVTNDSNKELVSEIGLIGSDGIPSFVPSVSPFVSEYTLSAQKDESIVGGVSIVSESRVSQGNTDGAGTCLDHKSGISTGKLAANESNKSNKSSLREQRDGKFSFCSPASVMGADGCCVVPSPSLRPLVGKASHILRQLKINLLDMDAALLAIALRPSKAVPDRRQAWRTFVKSAKTIYEMIQATFTLEDMIKTEYLRNDWWYWSSFSAAAKSSTLPSLALRIYSLDLAIIYEKMPNSSFTDSSEPSVIAEPKPLMNVDTEKSKASRKSTRKRKESDS

SEQ ID NO: 837 - protein, 556 aa, Zea mays; identical to SEQ ID NO: 688

SEQ ID NO: 838 - protein, 1852 aa, Sorghum Bicolor
MQFMPAFDLAQCLGMRQNLTSMDRDLNADGNVPQRSVNLRRRRDLPQTSTLPKVADNHELGSAGISMDPSFFNNAIEQSPSENRSSLKPPKFLMENSNHQPHHHTVALPVQCSDFFITSLGEIDNRTSYHNSYQIWPVGFTSYWHDRVTGSLFECEVIDGGNFGPLFKMRRLPCSAFQLPDASTTVCPNVVRKADTIETREGSGSIEDTTNDADDNISMLLSDFSDTNQDFLSCLGNDMEGKESLGCSNVQTSSMTVPAVLSDLGSLSLAPTNDANMYDKIGDFSYEGTSPSSVWRMVCCAMMEACEKMYKEHGHLVLFCTHSSEKSSFDYGSGRQRTDSPFDLFAKFCSSNGPKVPRFIEKENDVESTCALLKEWLYPDRIGFDMEFVQEFVESLPKSRACSNYQFLCNRTGINSSLTIASGTLIAVNKNSPSHGDVMSYGRHGSVVSGPQDHAQPSSFSIRELPPGNPISCKLPPELAGDVLQILEFLGRFAEIIGLKELPSIEQVEDELIDPWPIHVNENGTQNYRDHTPPMNSPANVSTSYSNGESGITIEEMVSVFIPIETSSAREAAQNKLAAQTLGRCSGLVLPEIHLALLKVLFTELVSRVAIFVDPKFDLKESKSRRGRKRDTDTLARELKIDMLTANNLTWPELARRYILAVSSMSGCMDLSDISSREGVKLFRCLQGDGGVLCGALPGVVGMEKDASLLAEAETLICKSSANEGNKVFMMDYKDADIVDSPEEPASDTTLPDWVKSLEPVRKLPTNVGTRIRKCVYEALEREPPEWARKILEHSISKEVYKGNASGPTKKAVLSVLTEACRTKVPQNTEKPRKERNIISISEAILKRCRIALRRAISSDESKQFANLLGTTLTNSNENEDEGILGFPGMVSRPLDFRTIDIRLAKGAYRGSWEAFLDDVQEVIRNLQTAFADRPEVVVMVAALSESFESLYKAEVQDLVEKFDKYLSNENGNSEIHQELQDALTTANNKLPKAPWEDGVCKVCGIDRDDESVLLCDTCDSEYHTYCLNPPLARIPLGNWYCPSCTAQTHVSVQEQKKCLGEEAHVFIEKLNKLAVAMDEKEYWELSVAERIYLLKFLCDELHNTALIREHLDQCSDRSNDLQQKLRHLNYELKELKYRVETKTSYATQSRWMKNDQIGNSSGLVENQQRAMPTASEHLEEAEQVNVGVNLSNPAEGVPAGQLNVGKPCSTDNGISSTSVIEGSKSLGLSKQPSEIVTDRTDRDSIGEGSKRFEKSLGGKSGTCDNLNVGETHSATVIIAPIGDLPDENARASSQDNMETSTSKLVDHDADNNESNNLLERISQLQDSISTVESQLSMASLRRDCLGRDSVGRLYWVTGRPSKRPRLVADGSMLIPKDRDISMVTSHSQSTFDKGWNSASLVMYESDEEIKSLVDWLRDIDPREKDLKDSILHWQKSLYHQASFPITDPPVSKSSKSEPPMELPNTKAFIVLEQKYGPQLDQDTSELSKRRGSKSKSGSEERVYRCDCLEPLLPFRHHCLNCHETYLTLTEYEGHNGVKCNSSNDCPTESKENDEPKLKGTKDPVDHNCSIEPSNSGKLESCPYDFEEICRKFITNDSNKETVKEIGLLGSNGIPSFVPSPAYFLDPPALLNENKRNDDKPNDWTSSLEECQAMSAKMSGPEGSQVGQDFSGNAGDGQMPKSKKPVRDGTSAKEAPSTDKPTRLLTVNGGLVPESSLMPVIGRNFHILKQLKINLLDVEAALPEEAFRASKSQQIRRRSWRAFVKDAELVSYVVLAINFLQSMIKAEFLKKDWWYWSSFTAAIKTTTVSSLALRIYTLDDCIMYTKDPSLNPEPADNARSGNKGKRKKDADS

SEQ ID NO: 839 - protein, 1949 aa, Oryza sativa
MPTPSQTIVFGSITGLVKEKEDSYLEFSWWFREDFGGVNGLLLCSSGALHLGTNAADGAHLTEFAVQLPHFEGLHLKNTALYDGNQFMPAFGLAHCLSMRQQFTSMDRDIMADGNIVQRSIHLRRKRRDLPQTSSLPKFAENHELGSANIFMDPSFYTKATESSSTENKSSSKPPKFLGENSSRRPHHRTVGLPVQYSDFFITSLGEIDKRPSYHNSYQIWPVGFTSYWHDRITGSLFECEVCDGGNFGPLFKVRRISCSVFPLPDASTILSQNSTRKAETIETNENNTLLEDTANDTDDNILMLLSDSSETNQDLLSCFSNDMESKMTSLGCNDLHSSNRSVPTVPSHSGTDKIGEFTFEGTSPSSVWRMISCAMMEACEKMYKEHGHLVFFCTHGTEKHSFDSGSGFQDFNGPYTPLTRFCSSYGPSIPRIVEKENDVEPTYSLLKEWLYQDRIGFDLEFVQEIVESLPRSRACSNYQFLCNRAEFVSSLTVASGSLRVVHKNGQSNGDVMSYGRHGSVVTGLQDHTQPSGFRIRELPLGRPISNKLPPELAGEVLQIWEFLGRFSEIIGLKEIPSYEQLEDELIDPWPICADQKEKLSNDIHRDHTSPINSPANVSTSYSNGESGLTSNEEIVSLFIPVETSSMKKAAQDKSAAQTLGRCSGVVLPGVHLTLFRVLFGELLSKVAIFVDPNIDPKESKTRRGRKKDTENLISAKEFKFDMLTANKLTWPELARRYILAISSISGCMDLSDISSREGVKLFRCLQGDGGILCGALPGVAGMEKDALLLVEAENLICKSSVNEESKVFMMDQKDTDMVDSPEVSATDNKTLPDWAKSLEPVRKLPTNVGTRIRKCVYESLERKPPEWARKILEHSISKEVYKGNASGPTKKAVLSVLTEACRVKVPHNPEKPRKERNAISISEAILKKCRIALRSAISSDESKLFGNLLGTTLVNSNENEDEGILGFPGMVSRPLDFRTIDIRLAMGAYYGSWEAFLEDVQEVIRNLHTAFGDRPDVLEMVVALSQSFESLYKTEVLDLVEKFDKYLSDKNAGSEMHEELHDILTAANSLPKAPWEDGVCKVCGIDRDDDSVLLCDKCDSEYHTYCLNPPLARIPEGNWYCPSCMLGQTKAHHDQGVQDVKRQQKKFVGEEAHAFQEELNKLATAMEEKEYWDLNMQERIYLLKFLCDEMLNTALIREHLDQCSDKLGDLQQKFRASNFELKDLKYKEEMRTSYARQSRSSKTEQHFNNSSGPVENQQQCTPTALDHLEEAEQGNVGVNLNNPADGVPDGQLNVGKPYKSDKDISSASMVEERKSSGLSEQPSGMAIDQIDGDAIDEGSQSCEKRSLGAKSSTCDNLNLKDTEFSTPGRELPDERASTSFQDNLEASSTKSIELDADNNEMDTLSDDISKLQDSISLLESQINMASSRRECLGKDSIGRLYWVIGRPGKRPWLVADGSMLKPKERDISMVNSYPPSAFDCKGWNSASIFIYESDEEIQCLLDWLRDYDPREKELKDSILQWQRHFCHQSSSPLVDPPISGPKGEQLMELPNTKAAVILEQKYGLQLDQDTSDLPKKRGKKIKLSSEDRTYRCDCLEPVWPSRYHCLTCHETYLISTEFEGHNDGKCSKIHQSPDESRENDEPKVKVTKSDTKEKDSLECSSVIEPSSDRKLMQCPYDFEEICRKFVTNDSNKETVKQIGLNGSNGVPSFVPSPAFFLEPAIVQSQNRKDDELKDWTSSLEECNAMSAQKLVQEVSKSGQSCPGNVGDEKVQKSKKPTPDNTSGEEAHSTTGKPTRLLAVNGGLVPESSLRPLIGRNSHILKQQKINLLDIEAALPEEALRASKCQQIRRRSWRAFVKDAESISQMVLAANLLEGMIKAEFLKNDWWYWSSFTAAMKTSTVSSLALRVYTLDDCIIYSKDQVPSVEPADNTRSGNRGGRRRRELESLAS

SEQ ID NO: 840 - protein, 2101 aa, Brachypodium distachyon
MDRPPHLDIDLNEEPSPPPSPPPPPVPLLPPPREVPPPIFALPPTPPPPPPPPLPLWPVPAAIAQEQLRFMHEREARELAVMYHQAELARAAAGRAIAVPPFPHPGPGEAGWGNPPGPCAVCGKPETPWETIICDACDRAFHQSCVRVWGPPVGTQPLPPPPPATPGVRRPAVTMNEDWMCPQCERNGKRSERWKLGPVRLDINAAPPPWTEDAAPTHWTEGPVLTRGIDPDGAHLTELPHFEGLHLKNTTLYDANQFMPAFGFSMRQPLASTDRDFVADGNVAQSSNHIRRRRRDFPQASTFPMFAEKHEFGSANIFMDPSVFTKATEPSPSEDRNAPMAPKFLLESNNRRLNHCTVGLPVQYQDFFITSLGEIDKRASYHNQHQIWPVGFTSYWHDRVTGSLFECEVQDGGSFGPLFKVRRLPCSVFPLPEASTILSQNGARKADTSETKESSSFIGDAAYYMDDNISSLLSDPSETNQYYLSFLANDMVGKRTSLNCNDGHSSNMTAPILPSHSDNVSLAPSKEANIHDRIGDFTFEGTSSSSVWRMISCAMMEACEKMYKEHGHLMFLCSHSSENHSLNKGSGCQNFDGPCAPLTRFCSSNGPTIPRLIEKKNDVESSCTLLKEWLYQDRIGLDLDFVQEILESLPGSLACLNYQFLCDRAKSVSCVTVASGSLVAVHKDGQSNGDTMSYGRHGSAVTGLQDHVQPSGSSIRELPPGHLISCKLSPELAGDVFQIWEFLGRFAEIIGLKEVPSYEQLEDELIDPWPICANQNELLSNAETGLTNNEEIVSVFIPVETSSMKEADQDKLAAQTLGRYSGVVLPGVHLTLFKVLFGELLSKVAIFVDPNIDPKESKPRRGRKRDTESLNSAKELNFDMLTANKLTWPELARRYLLAVSSISGCMDLSDISSREGVKLFRCLQGDGGILCGALPGVAGMEKDASLLVEAESLICNSSSNEGNKVFMMDYKDTDMIDSAEVPVADNKKLPDWAEPLEPVRKLPTNVGTRIRKCVYEALERKPPEWARKILEQSISKEVYKGNASGPTKKAVLSVLAQACRVIVPQNPENSRKEKKSISISDAILRKCRIALRRAISSDESKFFGNLLGTTLMNSNENEDEGILGFPGMVSRPLDFRTIDIRLAVGAYCGSWETFHEDVQEVIRNLHTAFGDRPDVLDMVVSLSQGFESLYKTEVLDIVQKFDFYLSNGNAGSEIHDELHDILSAATNLPKAPWEDGVCKVCGIDRDDDSVLLCDKCDSEYHTYCLNPPLARIPQGNWYCPSCMSGQKKSHLDQGVKDLKRQQKKHVGEEFHAFHEVLSKLAAAMEEKEYWELSIYERIDLLKFLCDEMLNTALIREHLDQCPDKLSDLQQKFRALNFELKDLKHKEEIRTSYARQSRISKIEQHLSNSSGLVQNKQNDVPTVSGHLEEAEVNLNRPAEGAPPGQLNVDKPCSSGNDMSTIEEYKSLGHSGQPSETVSDWIEGGTIDERSQSCEKRLLDGTISTCENLNLRGTPIAERAPVAPPLIPGGELPDENASTSFQDNLKTSSARSLERDADNDEMDSLSDDVSKLQDSVSIVESQLNMASLRRDCLGKDSLGRLYWVLGRPGKRPLLIADGSMLIRKERNISMVNNYDASLFHKGWNSASIFIYESDEEIRYLVDWLKDYDPRDKELKDAILQWQRHHNHQGGYLRDPPVSILSKNEQLMDLPSTKAAVVLEQKYGLQLDQDTSNLSRRRGRKTNIGSEERTYRCDCLEPVWPSRHHCLTCHETYFTSSEYEGHNSGKCNRNSHSPSESKENDELKVKSAKSDIKEKDSLDRSSAIESSSSRKLNSCPYDFEEICRKFVTNDSNKEIVKDIGLIGSNGVPSFVPSPAFFLEPAIILNKDKKDVPDDWTSSLEECQSMSAQQLGQEESKSGQNCPDNTCDENVPKSRKPTPDSTCEASSSVTHKPTSLLAVNGGLVPESSLRPVVGKNSHILKQQKINLLDIDAALPEEALRASKSQQIKRRSWRTFVKDAESICEMVLATSLLESMIRTEFLKNDWWYWSSFTVAMKTSTVSSLALRIYTLDDCIIYAKDPNVEPADNTKVINRGKRRKEPEPSAS

SEQ ID NO: 841 - protein, 2184 aa, Populus trichocarpa
MKLTTDSSDITSRSPLGIDLNEIPSTSTSSPPENSLDVVLSFHENPDPAPGMAAGLRAEGSMCGACGKPEVRGQVVVCDGCERGFHLGCAGRQAINSAEWLCGECLSGGVKSKRWPLGVKRILDINASPPSDAEDELLSNLRKHTQSQGDNSFGAPPLTYSNLFYTGYGLLSDVMRPMQTADTSAEGAGMSFPQGSLRSRNNTTIRLLSRNPSEIFLQGLREFISERHGVLEEGWSVEFKHSISNYDLYAVYCSPDGKTFHSMSEVACHLGLMPNRNSIDTDSTSYVSPSPQETLHLPRKSKSKRCSLTNVFSEHKTTLVSGYCKELFSNGQSIEINNANLGEVRESEMQGDGISDFQPSNEGLPVQFEDFFVLSLGKIDVRPTYHNASLIWPVGYRSCWHDKITGSIFLCEVSDGGDSGPVFKVRRVSCSLLPVPQGLTVLCRTNFGQYSSHNNQDCHHMIFHNIDCESDDNIELILADPAPPSYDDVLTCLQGSSNRTSEIMQTSSFDSRSENFLFSDKVLGEEIGEISVEERSSTSAWTVISQKLVDAYSEIHRQRGTLKVSCNHADNEMGSPGLYTKNENSNASSASLAKFCSCPNFVGIPLECQGELEAFSSTLSEWLDQDRFGLDTEFVQEMIEQLPGAKACLKYEFLINRGHYSVSPTVGNGFLMAKRKSRSESDALFQRSKKARLAKEILGDYQYPAGRPLCSRLPPVLVGDFYQVLELLWRFHEILGLKEPLSLEELEEELINPWSNLSHLLKNLENKVHGSEAIDFYEADSMSGLNSFLPDKSGMTVCEGNSHACVNDEGCRMGVKDGGQATVASVTHISRSGVASTNAHCSLLGMLISELQCKIAPLVDPNFDSGETKSKRGRRKDADSSAPTRRNNLNMLPINELTWPELARRYILAVLTMDGNLESAEITGREMGRVFRCIQGDGGVLCGALTGVAGMEADALFLAEATKKVFGSLSRKKDFLSIEDETADTSCDHENNNMKDGNIPEWAQVLEPVRKLPTNVGARIRKCVYDALEKCPPEWAKTRLEHSISKEVYKGNASGPTKKAVLSVLADVLTGVQQKAVKTNKKKISIPISDIIMKQCRIVLREAAAADDAKVFCTLLGRNLRNSCDTDDEGLLGSPAMVSRPLDFRTIDLRLAAGAYGGSHESFLEDVRELWSHVRMAFREQGDLVELAETLSQNFESLFEKEVVTLVKKFEGYAKLDHISAEIKKELDDFLASIHEVPKAPWDEGVCKVCGVDKDDNSVLLCDTCDAEYHTYCLNPPLARIPEGNWYCPSCVVSKHVVQEASGISQVIGIVHCKKYQGEITHVYLEKLSHLSVTMKEKEYWEFSVDERIYLLKFLCDELLNSGLIRQNLEQCAETTNELQQKLRAFSMEWKTMKSKEEFLASRAADMDGSAVGEVGLKEALASAIPNQPKQAGQQPDVSDGPSHCSSFGHDVPALNGGQDGTRINGFDKYPSVSSSGKNHSCNSQTVNHTDTKEQVNDPLAVVDGSKLPSRENEKSSGPNNLSQIIGDMDEIQFQGNLQGYAGRGTSLLPPPDVGFGTALEENSRVSQHVPPVAINESEGFNLELSAVKNDLLHLQNSISRIQSQLLKLSVRREFLGSDSRGRLYWASTGRGSDQRVIVDGSLTLQQRNSDQFGTRLNLEEQKTFFPFQCTSNNVLAMCSPCVSYETEEEIEQLISWLKDDVQKERELKESISQCLKQRFQETRQARDLVQEEHQALSVITNNNNTAFANYLVTKAAMFLEKKYGPLVELHTSDKLVKRARVTGEGKMYRCDCLEPILPSRHHCLSCHRTFSDDIEFNEHNGGRCNLITPANAKSEYISGFVKVKGNMKSQTTQKVPISEMDVVETSRSGSSGLGSRLIKSQNEGICPYDFSEISSKFVTEDSNKELVHKIGLIGSNGVPSFITSLSSDLNHSMSMLICHGENNGVVGDELSIDGRMVVSKGKKSESSAALDNIYDNSSWKSVANEISKVSKTEKPPPGHVEHRKKKSSSNKHFPEIGAGFCCVVPRSSLRPLAGNVLHILRRLKINLLDMEAALPEEALKPSKVHLDRRLAWRVYVKSAGSIYEMIQATIILEEMIKTDYLRNEWWYWSSFSAAAKTSTIASLALRIYSLDAVIVYEKATPNLDSTNSLKPVGMLDKKPLPGLDLTDKSKVSRKSNKKRKEPE

SEQ ID NO: 842 - protein, 2190 aa, Brassica napus
MELTDSTKKQLGETRSAALDEDNRSFLGIDLNEIPTGATPGGAVQDDDGEYEPVEVVRSIHDNPDPAPGAPAEVPEPDRDAACGACGRPESMELVVVCDACERGFHLSCVDDGVEAAPSADWMCSDCVAGGGRSKLWPLGVKSKLILDMNASPPSDAEGYGGEDTSDSRKHMLAMGNSFEHSMTHSSFLDPGRAHTLGFGFPSNLGNSTLPIRFPSLDPSELLLQNLRHFISERHGVLEDGWHVEFKQPLNGYHLCPVYCSPSGKTFSSIQDVACYLGLATNGNYSCMDTDIRNESSLLQERLNMPKRRKTSRWPNNSFPDLKGSSVSAQLSRFPYNGQTMPPFAISSGESLSSGNNGCGCEEANKGLPMQFEDFFVLSLGRIDIRQSYHNVNMIYPIGYKSCWHDKITGSLFTCEVSGGSSGPVFKITRSPCSKSFVPVGSTVFSCPKIDEMVEQNIDKRGDRRDSIQEHDDDTVEILLSDPSPPLGDDILSCLQEKSFSSTFYCLRSEVGSSQVDLNNTLSYNQQHEVEIGDIIVEEDSLSVAWQKVSQKLVDACSNVLKHKGTMNFRCKHVDRETREINWDTRNEKDNVILSLSRFCCSLAPHSATCGGKDNSEIASLVDVLSRWLDQSRFGLDADFVQEMIERMPGAESCSNYRSLKTRSSSVSVTVAEGALIANPKVGENVREEVFGEISRKAKRHKLNGGHGFSNPHPPPGRPMCLRLPPVVVGDFLQVSEVFWRFREILGLGEAFSPEKLEQEIVNPVFDGLFLDKSGKEVNRSEMNISDEDRTATKFLSLLDESRQPFSSENTFASVLKETKAGDSTEFNISNSSRGPCVGALLTKTHISLLQVLICELQSKVAAFVDPNFDSGESRSRRGRKKDDSTLSAKRNKLHMLPVNEFTWPELARRYILSLLSMDGNLESAEIAARESGKVFRCLQGDGGLLCGSLTGVDGMEADSMLLAEAIKKIFGSLTRENDVLSVEDDDSDGLDATETNACNGDIPEWALVLEPVRKLPTNVGTRIRKCVYDALERNPPEWAKKILEHSISKEVYKGNASGPTKKAVLSLLADVRGGDLVQKSVKGTKKRTSIGVSDVIMKKCRAVLRDVAAVDEDKVFCTLLGRKLLNLNDNDDDGLLGSPAMVSRPLDFRTIDLRLAVGAYDGSTEAFLEDILELWSCIRVMYADQPDSLELVEKLSKKFKSLYEAELGSLLKSNGRDSLIKQILLRLIVCESYRSLRSELDAFEGFFLLCACRIIVVLAFQFPGVVLPLAQKLMDYRKLECLSAEMRKEIKDIVVSVNKLPKAPWDEGVCKICGVDKDDDSVLLCDTCDAEYHTYCLNPPLIRIPDGNWYCPSCVIAKRMAQDALESNKLVRRRKRRKYQGELTRASMETAARLVDVMGEKDYWEFSAEERILVLKLLCDELLSSSLVHQHLEQCAEALIEMQQKLRSLSSEWKNTKLRQEFLTAKLAKVEPSILKEMGEPQNSSSFADHHGRHQQQENVGEKVPHDDGTSSAAFLTNNQGKAPIETHAQTGGSNVISSENKIHTPEKVTSPGRNELPIEVTDHMSCEIEDTTETLDKSVGKNRETHSIKPNAAELKTAHDASSLASQELQACRQDLNATSNEIQNLQQSIRSIESQILRQSIRRDFLGSDGSGRLYWGCYFAEEHPRILVDGSMSLQKAVQVDLTGSKVPSPFLHAVDHGRLMVSPWTYYETEAEISELVLWLHDDDPKERELRESIMCWKRIRFGDLQREIKQAENSSSPIMAGDLVTKAAMAMEKRYGPCIKLEIETYKKRGKKTKCAEREKLCRCECLESILPSMIHCLICHKTFASDDEFEEHAESKCVPYSLATEEGKEKSDSSKAKESLKSDYLSVKSSAGKDKAEISNVSELGSGLIRYQEEESISPYHFEEICSKFVTKDSNRDLVKEIGLIGSNGSPTFLPLPSIHLNDPMLISATCNKLDGGDSGDQVIFTGSEANGEGLNSESLDRSVTNDLGNPLNKLSGMGCDKSEEKNKKSTGSGLKGCCVVPQASLKRVTGKALPVFRFLKTNLLDMDVALPEEALRPSKSHPDRRRAWRAFVKSAQSIFELVQAAIVVEDMIKTEYLKNEWWYWSSLSAAAKISTLSALSLHIFSLDAAIMYDKTITQSDPMDATKEIGLQEQKSQPVTDPQERSSRANRRSGKKRKEPEGA

SEQ ID NO: 843 - DNA, 3738 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggttgagaaaccgtacaagtgcccggagtgtggtaagtcattttctaggtccgacgaacttgtcagacaccagcgaacgcatactggtgagaaaccttataagtgccccgaatgtgggaagtcattctctcgttccgataatcttgtgcgtcatcagaggacccatacgggcgagaaaccctataaatgtcccgaatgtggaaagtctttttcacagctcgcgcacctacgagctcatcagcgtactcacaccggggaaaaaccgtacaagtgccctgaatgcggtaagagcttttcaaggagcgataacctggtgcgtcatcaacgaacccacacgggcgaaaagccttacaagtgtcccgagtgcggtaaaagtttttctacgtccggtaacttagtccgtcaccagagaacgcatactggagaaaaaccttataaatgtccagaatgtgggaagagctttagccaattagctcatttgagggcacaccagcgtactcatactggaaaccgcgccaagcttggtaccgactacaaagacgatgacgacaaagactacaaagacgatgacgacaaagactacaaagacgatgacgacaaaggatcccttgaggttcttttcggcgcgccaagctatcaaacaagtttgtacaaaaaagcaggctccgcggccgcccccttcaccgagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattag

SEQ ID NO: 844 - protein, 583 aa, Artificial Sequence
  Synthetic Construct
MVEKPYKCPECGKSFSRSDELVRHQRTHTGEKPYKCPECGKSFSRSDNLVRHQRTHTGEKPYKCPECGKSFSQLAHLRAHQRTHTGEKPYKCPECGKSFSRSDNLVRHQRTHTGEKPYKCPECGKSFSTSGNLVRHQRTHTGEKPYKCPECGKSFSQLAHLRAHQRTHTGNRAKLGTDYKDDDDKDYKDDDDKDYKDDDDKGSLEVLFGAPSYQTSLYKKAGSAAAPFTETIRLPKPMIGFGVPTEPLPAMVRRTLPEQAVGPPFFYYENVALAPKGVWDTISRFLYDIEPEFVDSKYFCAAARKRGYIHNLPVENRFPLFPLAPRTIHEALPLSKKWWPSWDPRTKLNCLQTAIGSAQLTNRIRKAVEDFDGEPPMRVQKFVLDQCRKWNLVWVGRNKVAPLEPDEVEMLLGFPKNHTRGGGISRTDRYKSLGNSFQVDTVAYHLSVLKDLFPGGINVLSLFSGIGGGEVALYRLGIPLNTVVSVEKSEVNRDIVRSWWEQTNQRGNLIHFNDVQQLNGDRLEQLIESFGGFDLVIGGSPCNNLAGSNRVSRDGLEGKESSLFYDYVRILDLVKSIMSRHKH

SEQ ID NO: 845 - protein, 171 aa, Artificial Sequence
  Synthetic Construct
MVEKPYKCPECGKSFSRSDELVRHQRTHTGEKPYKCPECGKSFSRSDNLVRHQRTHTGEKPYKCPECGKSFSQLAHLRAHQRTHTGEKPYKCPECGKSFSRSDNLVRHQRTHTGEKPYKCPECGKSFSTSGNLVRHQRTHTGEKPYKCPECGKSFSQLAHLRAHQRTHTGN

SEQ ID NO: 846 - DNA, 3654 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggttgaaaagccatataaatgtcccgagtgcggcaagtcttttagcagatccgacgagctagtacgtcatcagagaacccacactggcgaaaaaccttacaaatgccccgagtgtggtaaaagtttttctcgaagcgataacctggtgcgtcatcagaggactcatacgggcgaaaagccctacaagtgtccggaatgcggcaagtcctttagtcaactcgctcatttaagggcacaccagcgaacgcacactggcgaaaaaccatataaatgccctgagtgcggcaagtctttttccagaagtgataatttggttcgacatcaacgaacgcataccggggagaagccctataaatgccctgaatgcggaaaatcattttccacgtcaggcaaccttgtccgtcatcaacgaacacacactggcaaccgcgccaagcttggtaccgactacaaagacgatgacgacaaagactacaaagacgatgacgacaaagactacaaagacgatgacgacaaaggatcccttgaggttcttttcggcgcgccaagctatcaaacaagtttgtacaaaaaagcaggctccgcggccgcccccttcaccgagacaattcgtttgcccaaacctatgattgggtttggggttcctaccgaaccacttccagcaatggttcgaagaactcttcccgagcaagctgttggacccccgtttttctactatgaaaatgtggctctagctccaaagggtgtgtgggacacaatttctagatttttgtacgatattgagccagagtttgtcgactccaaatatttttgtgctgctgcaagaaaaaggggttatattcataatctgccggttgaaaatagatttcctttgtttccacttgccccacgtaccattcatgaggcacttcccctatcgaagaaatggtggccatcttgggacccacggacaaagttaaattgtttgcaaacagccattggaagtgcacaattgacgaataggattaggaaagctgtggaggactttgatggtgagccaccaatgagagttcagaagtttgttcttgatcaatgtcggaagtggaatttggtgtgggttgggagaaacaaagttgctcctttggagcctgatgaagttgaaatgctactgggatttccaaagaaccatactaggggaggtggtataagtaggaccgatagatacaagtcgcttggtaattcattccaggttgacactgtggcataccatttgtcggtattgaaagacttgtttcccggtggtatcaatgtcttatcactcttctctggaattggcggtggtgaagttgctctttatcgtcttggtattccactaaacacagtggtttctgtggaaaaatctgaagtcaacagggatattgtgagaagctggtgggagcaaactaatcagagagggaaccttatacattttaacgatgtgcagcagctgaatggagaccgcttggagcaactgatagagtcatttggaggatttgatttggtaattggtggaagcccgtgcaataaccttgcaggcagtaacagagtgagcagggatgggcttgaaggcaaagagtcttccctattttatgactatgttcggatattggacttggtcaagtccataatgtccagacataaacattag

SEQ ID NO: 847 - protein, 555 aa, Artificial Sequence
  Synthetic Construct
MVEKPYKCPECGKSFSRSDELVRHQRTHTGEKPYKCPECGKSFSRSDNLVRHQRTHTGEKPYKCPECGKSFSQLAHLRAHQRTHTGEKPYKCPECGKSFSRSDNLVRHQRTHTGEKPYKCPECGKSFSTSGNLVRHQRTHTGNRAKLGTDYKDDDDKDYKDDDDKDYKDDDDKGSLEVLFGAPSYQTSLYKKAGSAAAPFTETIRLPKPMIGFGVPTEPLPAMVRRTLPEQAVGPPFFYYENVALAPKGVWDTISRFLYDIEPEFVDSKYFCAAARKRGYIHNLPVENRFPLFPLAPRTIHEALPLSKKWWPSWDPRTKLNCLQTAIGSAQLTNRIRKAVEDFDGEPPMRVQKFVLDQCRKWNLVWVGRNKVAPLEPDEVEMLLGFPKNHTRGGGISRTDRYKSLGNSFQVDTVAYHLSVLKDLFPGGINVLSLFSGIGGGEVALYRLGIPLNTVVSVEKSEVNRDIVRSWWEQTNQRGNLIHFNDVQQLNGDRLEQLIESFGGFDLVIGGSPCNNLAGSNRVSRDGLEGKESSLFYDYVRILDLVKSIMSRHKH

SEQ ID NO: 848 - protein, 143 aa, Artificial Sequence
  Synthetic Construct
MVEKPYKCPECGKSFSRSDELVRHQRTHTGEKPYKCPECGKSFSRSDNLVRHQRTHTGEKPYKCPECGKSFSQLAHLRAHQRTHTGEKPYKCPECGKSFSRSDNLVRHQRTHTGEKPYKCPECGKSFSTSGNLVRHQRTHTGN

SEQ ID NO: 849 - DNA, 10507 bp, Artificial Sequence
  Synthetic Construct
gcactgatgcacatgaggagtgcaaatttgaaaatataagataagaaacatgttgcaaagctgccacccaccgtatccaattgctactatttgtatcaatcagttacaaactgaaaaccaaaaatgaaatgactagaacaaataatgttaaaatgcacattgaaatagttaacaaggaaagcatacattgatcgataaaacgaatccaccacgttccaaaatattttgtcgcagatgttgcagacttgtagctaagttgggccggtagatgtaggtgacaagtgtttacaaatctgttaactgtcgctgtgttcctcctacttttgattttgtgttacactattcaaaagttggtcgactcttttaatcggttgattagactagtacttagtaaaatttgttgttaaaacttaaaagggagaagaagaagaagaatactgctttaattcttaattaatttttttttaaaattagtagtatcattaacgtgtttattacaccttcctcgagttactttcctcgtgatgccaatggtttttttaattctttaccttttcttctgacacagagtcacatatttgactacggaggagatctattgcttcctagttcctacttatctttatcgcgttgtaccaacatcaatataaaagcaacatcttactttataaacttccgtaaatttgataacaagtacaatcaagtttaaatttttctaaagttaacataaatttagcatcatacaataattaacattttttttaggttaaacttttggtgcgttacgtgagtagcagcatcttcgaaaatatgtttagtagtagtagtgataggaattaggaaaaggcacacacaaaaaagaaaaaaaaagggtaaaaggattcattcacgtttttttgttttctctctccaaacagaacttcgggaaaagtggacaaaaaaaaagaaaaaaatttaataagaaaacctctttttctcgcaatttggttttgttttcaatcttcttcttcttcttcttcgtcttcaatgcaaacaatgctcgattccattaacctaatcgaataatggaacccactgattctactaacgagcaactcggagacactaagaccgccgctgtcaaggaagagagtcgctcctttctcggcatcgatctcaacgaaatccctaccggcgctactctcggcggtggttgcaccgctggtcaggatgacgacggcgaatatgaacctgttgaagttgttaggtcaattcacgataacccggacccagcccctggagcccctgccgaggttcctgaaccggatcgggatgcttcgtgcggcgcgtgtggaagacctgagtctatagagctcgttgtagtctgcgatgcctgtgagcgaggctttcatatgtcttgtgtcaacgatggagttgaggcggctccttccgccgattggatgtgcagcgactgtcgtactggcggcgagaggagcaaactgtggccgttgggggttaagtccaagctcattctggacatgaacgcctcgccgcccagtgatgctgagggatacggagctgaggagacgtctgattcgaggtacgttcccctgcttctggtattcgacgatgcgttagggttttataagaattgaatttgggttgagatcgagaacatagttgcaagacttggttaagctgtctttacatgtattgcgagtaatgtgttcgattttaaagcgataaactattgaagattaagctggactaggatttggtgttgttgaatttaagtttcagtataagttgagcgttctgtgctaccgttcgttggagtttttaaggggcctttgatcttctcttatgaattacttatacatacgatatattttcaatcagttgtttagactttatttgattggacttgtctggccttatataacatgagtatgtctgagaaaacacatagccgaaattgtaaagcactgatggatcatgtggttgcttgtttcttcttctccagaaagcatatgctcgccagcagctcttgcattggaaactcttttgattatgcaatgatgcattcaagcttctcaagtctcggtagaggacatgctagtctcgaagcttcagggttaatgtctcgtaatactaaaatgagtatggatgcattgggttcacataatctaggttttggattcccattaaacttgaacaatagtagtttgcccatgagatttccatccttggatccaagtgagttgtttctgcaaaatctcaggcatttcatatctgaaaggcatggagtattggaagatggctggcgtgtcgaattcagacaacctttaaatggttatcagttatgtgcagtgtattgtgctccgaatggaaaaacatttagttcaatacaagaagttgcttgttatctgggcttggcaattaatggtaactacagctgtatggatgctgaaatcaggaatgagaattctcttcttcaagaaagattgcatacgcccaagagaagaaagacatcaagatggccaaacaatggtttccctgagcaaaagggtagttcagtgagtgctcaactcaggcgttttccattcaatggtcagaccatgtctcctttcgccgttaaatctggtactcattttcaggctggtggttctcttagctctggaaataatggatgcggttgtgaggaagctaaggtaagcgtaaaattgaaatctctcctgattgattgttttttccaatatttttgtaattcttaccctcatgtttgtgtatttgattttcagaatggatgtccgatgcagtttgaagatttctttgttctgtcgcttggacgaattgacataagacagtcttaccataatgtcaacgtgatttatccaataggatataagtcctgctggcatgacaagatcacggggtcactatttacatgtgaagtatctgatggcaattctggtcccattttcaaggttacacggtcaccatgctcgaaatcatttattccagctggatcaactgtcttctcctgcccaaagattgatgaaatggtggaacagaacagtgacaaacttagtaatcgtagagatagtactcaagagcgtgatgatgacgctagtgttgagatccttctttcggaacactgcccacctcttggagatgatatattgtcttgtttacgtgagaagagtttctccaagacagtcaattccctgcgctcagaggttgattcttctcgagtagattttgataaaaatttatcctatgatcaggaccatggggttgaaattggtgacattgttgtggaagaagattcattgtctgatgcatggaaaaaagtgtctcaaaaacttgttgatgcatgttcaattgtactgaagcagaagggtaccctgaatttcctatgtaagcatgttgacagagaaacaagtgaaatcaactgggataccatgaatgagaaagacaatgtaattttatcgttgtcaaaattttgctgttcgttggctccttgcagtgtcacgtgtggtgaaaaggataaaagcgaatttgcagcagtagttgatgctttgtcaaggtggctcgatcaaaacagatttggacttgatgcagattttgtacaggaaatgattgaacatatgcctggtgccgaatcatgtacgaattataggactctgaagagtagaagttcttcttctgttcctataactgtagcggaaggagcgctagtggtcaaaccaaaaggtggggaaaatgtcaaggacgaagttttcggtgagatttctcggaaagccaagaagcctaaactaaatggtggtcatggtgtcagaaatctacaccctcctcctgggaggccaatgtgtttgaggctccctcctgggcttgttggtgacttccttcaggtacggatatacgttttccttatatggtaatctacaacctacccctccattcactaagtcatgccgcacatatatgatagtcattttttatgcttgcctaattaggtatctgaagtgttctggcgtttccatgaaattttgggttttgaagaggctttctcacctgaaaaccttgaacaggagcttatcaatccagtgtttgatggtttgtttcttgataaacctgggaaagatgataagagaagtgagattaactttactgataaggattctacagctactaaacttttttctttgttcgatgaatctcgccaaccttttcctgcaaaaaatacctctgcttctgaactaaaggagaaaaaggcaggggattcttctgattttaagatttcagattcctctcgtgggtcgtgtgtgggtgcacttctaacaagggctcacatttcgcttctgcaagtgctaatatgtgagctgcaatccaaggtagctgcatttgttgatccaaactttgattctggcgaatcgagatccagacgaggacgaaaaaaggatgacagtacactttctgctaaaagaaataagctgcatatgcttcctgttaatgagttcacttggcctgaattggcccgtaggtacatcttgtctcttttatccatggatgggaacctcgaatcagcagagattgctgcacgtgaaagtggtaaggtattccgttgcttacaaggggatggtggtttgctttgcggctcgcttacaggagtggctgggatggaagcagattcaatggtatgtttttgttagttttctgattatttcctggattatatatcttgcttgtattactggatgatgggatcacaaattcagtttcacttttggaaacgccgcctatgtgctatttttcttttctcttcaaatgttctaaagcttatttgaagctatgttccacttgtaggtcactctagagtaattgacctttctttctcttcttggatcttgttagatgtattttgacatttagaggctgtttatcttgatatcttgaaggccctcttatatttatactgactggaaaattgggttactttgtgtttcaaatgagttcatgagctacctccactgaaagagaatgatcgttggatttacgtgtttatattaactctttatcttcagttacttgcagaggctattaagaaaatatctggttcgttgacaagcgaaaatgatgttctttctgtggaagatgatgattccgatggccttgatgctactgagacaaacacttgcagtggtgatattccagagtgggctcaggttttggaacctgtgaaaaagcttccaacaaatgttgggactagaatcagaaagtgtgtctatgaagctttagagagaaatccaccagagtgggcaaagaagatattggagcattctatcagtaaagaaatatataaaggcaatgcatcaggaccaacaaaggttcaaaatctctgaaaccaattctcttccctcctgaaatactgtacttgcaattttaaagtatttcttgttttctcaaattcactttgtttttctgtctcttgttcttgcggtgatgtaatctcagtctgatgatgcatgctactttcttagactcacattaattctgagattagttatttccctcttactggacacagaaagctgtcctctcattgctagcggatattcgaggtggagacttggtgcagaggtctattaaaggaaccaaaaagcggacatatataagtgtatctgatgtcattatgaagaaatgccgtgctgtattgcgtggtgttgcagctgcagacgaggataaagtcctttgcactttactgggaagaaagttactgaattccagtgataatgatgatgacgggctcctgggatcacctgcaatggtttcgcgtcccttagacttcagaactattgatttgaggttggctgctggtgcgtatgacggatcaactgaagcttttcttgaagatgttcttgaggttggattttccctcttatgtctgatttttctttgtgcaattgatggtatgatgctttttgtgcgatttaacaattagtttctgaatgcttatactaaaactgctattcattttgggcatttcatgtttctgctgttagtttaacactgctggtttagatgcgtaagtgtaaagtatcacaagagccagatttatattaggaatacttttactttctctttatgtcatagaagtatcaggttaaacggttgaacgccagaatttttgctggctcatttgataactttagatttgaatgcatgcaacttgattttttatagatgacatgctaaatataactttctaatttgcagctgtggagtagtatacgtgttatgtatgcagatcagcccgattgtgtggacctggttgcaacattgtctgaaaaattcaagtcgttatacgaggctgaggtttgtcttctctctcctttttctgctatgctctgcacaatagatatattcattacttagtagcatcttgaagtggagacagtcgtttatattttggcacttttgtgaaataaatgtgttaagatttatcatttctgaaagttataggccgatcaaagaagcatctggagatgcccattaatgctatatgctatgctttagaagggttcttccttttgtctgcgtgtatgattttcattgtgttcgcctttcagaaattgtatgcatggtctcctttttctatgagaatagttgcagtatcggggtgctattattttctcaagtttcaagcctttatttatttgctggtataggttgtaccacttgttcagaaacttaaggactacaggaaattggaatgcctaagtgcagagatgaagaaggaaattaaggacatagttgtttcagtaaataagcttcccaaggccccgtgggatgagggggtatgtaaagtatgtggcgttgacaaagatgatgacagtgttctcttgtgtgatacatgcgatgctgagtatcacacatattgtttaaatccacctcttattagaattcctgatggaaattggtattgtccatcttgtgtcattgccaagcgcatggctcaagaggctttggaatcttacaaactagttaggcggcggaaaggtagaaagtatcagggggaactcacccgagcttctatggaactgactgctcacctggcagatgtgatggaagaaaaggactactgggagtttagtgctgaggaggtcagttttgaaacttgtctcccattttttgctcattcattcgaaatgtgtcaacttttcattcccaacatgattttatttcgtggtgattacttgtgcaagtgatccctttacctataaattcttacaatcttttggtgctgtttccattggtattatggttgaatttttccctattctgatgcagagaatcttgctgcttaagcttctatgcgatgaactgcttagttcatctcttgtccatcaacaccttgagcagtgtgccgaagcaataattgaaatgcagcagaagttacgctctctttcctcagaatggaaaaacgcaaaaatgcggcaagaattcctgacggctaaactggcaaaggttgaaccgagtattctgaaggaagtgggcgaaccacataattcaagctactttgcagaccaaatgggatgtgatccacaaccacaggagggcgttggagacggagttactcgtgatgatgagacttcctctactgcatatcttaacaagaatcaaggtaaatctccacttgaaaccgatactcaacccggagagtcgcatgttaatttcggtgagagcaaaatttcctccccggaaacaatatcatcccctgggaggcatgagctacctatagcagatacctctcctcttgtaacagataatctgcctgaaaaagatacctcggagaccttgcttaagtcagttggaaggaatcatgaaacacattcaccaaattccaatgcagtagaattgccgacagctcatgatgcatcttctcaggcttcccaagagttgcaggcttgtcagcaggatttgagtgccactagtaatgaaattcagaatcttcagcaatcaattagaagcatagaatcacagcttctaaagcaatctatacggagagattttctgggaaccgatgctagtggtcggttatattggggttgctgcttcccagatgaaaatcctcgtatattggttgatggaagcatatctttgcagaaacctgttcaagccgatttgataggttcaaaagtcccctctccgtttctccataccgttgaccatggaagactaaggctttcaccctggacgtattatgaaactgaaaccgagatcagtgagcttgtccaatggcttcatgatgatgatctgaaagaaagagacctgagagagtctattttgtggtggaaaaggttacgatatggagacgttcaaaaggaaaagaaacaagctcagaatttatctgctccggtatttgctacgggtcttgagaccaaggctgccatgtcaatggagaagagatatggtccatgcatcaaactggagatggaaaccttaaaaaaacgggggaagaagacaaaggttgcagagcgagagaaattgtgtagatgcgaatgcttggaatccattttgccatctatgattcactgcctcatatgccataaaacattcgcaagtgatgatgagtttgaggatcacactgagagtaagtgtattccttattcattagcaactgaagaaggcaaggacatctctgattcttcaaaagccaaagaaagtctgaaatccgattatcttaatgtaaagtctagtgccggcaaagatgtagctgaaatatccaatgtttctgaacttgattctgggttgataagatatcaagaagaagaatctatttccccataccattttgaggagatctgttccaagtttgtgacaaaggattgcaacagagatttggttaaagagatcggtctgatcagttcaaatggcattccaacatttcttccatcgtcatctactcatcttaacgactccgtgctcatctctgccaaatccaataagccagatggtggtgattcaggggatcaggtcatttttgctggtcctgaaaccaatgttgaaggcttaaattctgaatctaacatgtcattcgatagatctgtcacagacagtcacgggggtccactggataaaccaagtggactgggttttggcttctcagagcaaaagaataagaaatcttcaggtagtgggttgaaaagctgctgtgtggttccacaggctgctttgaaacgagtaactggcaaagctttgccgggtttcaggttcctgaaaaccaacttgcttgatatggatgtagcactgcctgaagaagctttaagaccatcgaaatcacatccaaaccgtagaagagcttggcgtgtatttgttaaatcgtcgcaaagtatatacgaggtttgttttaatccttaaccttttctgctctctatctatagaaacagataacaagctgtttttctaatatctacgcttttcgtatttatttcagttggttcaggcaacaattgtggtagaagatatgattaagacagagtacttgaaaaatgaatggtggtactggtcttctctttcagcggctgctaaaatctcgactctctcagcgttatccgtccgtatcttctccctcgacgctgctatcatttatgataaacccataactccatcaaatcctatcgatgaaacaaagccgatcatcagcttaccggaccaaaagtcacagccggtttcggattctcaagaaagaagcagcagagttagaagatctggcaagaaaaggaaagaacccgagggatccaagggtgggcgcgccaagcttggtaccgactacaaagacgatgacgacaaagactacaaagacgatgacgacaaagactacaaagacgatgacgacaaaggatcccttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgagggatctatggctggtggacttaacgatatcttcgaagctcagaagattgaatggcatgaggatactggtggatcttagtagtag

SEQ ID NO: 850 - protein, 2414 aa, Artificial Sequence
  Synthetic Construct
MEPTDSTNEQLGDTKTAAVKEESRSFLGIDLNEIPTGATLGGGCTAGQDDDGEYEPVEVVRSIHDNPDPAPGAPAEVPEPDRDASCGACGRPESIELVVVCDACERGFHMSCVNDGVEAAPSADWMCSDCRTGGERSKLWPLGVKSKLILDMNASPPSDAEGYGAEETSDSRKHMLASSSCIGNSFDYAMMHSSFSSLGRGHASLEASGLMSRNTKMSMDALGSHNLGFGFPLNLNNSSLPMRFPSLDPSELFLQNLRHFISERHGVLEDGWRVEFRQPLNGYQLCAVYCAPNGKTFSSIQEVACYLGLAINGNYSCMDAEIRNENSLLQERLHTPKRRKTSRWPNNGFPEQKGSSVSAQLRRFPFNGQTMSPFAVKSGTHFQAGGSLSSGNNGCGCEEAKNGCPMQFEDFFVLSLGRIDIRQSYHNVNVIYPIGYKSCWHDKITGSLFTCEVSDGNSGPIFKVTRSPCSKSFIPAGSTVFSCPKIDEMVEQNSDKLSNRRDSTQERDDDASVEILLSEHCPPLGDDILSCLREKSFSKTVNSLRSEVDSSRVDFDKNLSYDQDHGVEIGDIVVEEDSLSDAWKKVSQKLVDACSIVLKQKGTLNFLCKHVDRETSEINWDTMNEKDNVILSLSKFCCSLAPCSVTCGEKDKSEFAAVVDALSRWLDQNRFGLDADFVQEMIEHMPGAESCTNYRTLKSRSSSSVPITVAEGALVVKPKGGENVKDEVFGEISRKAKKPKLNGGHGVRNLHPPPGRPMCLRLPPGLVGDFLQVSEVFWRFHEILGFEEAFSPENLEQELINPVFDGLFLDKPGKDDKRSEINFTDKDSTATKLFSLFDESRQPFPAKNTSASELKEKKAGDSSDFKISDSSRGSCVGALLTRAHISLLQVLICELQSKVAAFVDPNFDSGESRSRRGRKKDDSTLSAKRNKLHMLPVNEFTWPELARRYILSLLSMDGNLESAEIAARESGKVFRCLQGDGGLLCGSLTGVAGMEADSMLLAEAIKKISGSLTSENDVLSVEDDDSDGLDATETNTCSGDIPEWAQVLEPVKKLPTNVGTRIRKCVYEALERNPPEWAKKILEHSISKEIYKGNASGPTKKAVLSLLADIRGGDLVQRSIKGTKKRTYISVSDVIMKKCRAVLRGVAAADEDKVLCTLLGRKLLNSSDNDDDGLLGSPAMVSRPLDFRTIDLRLAAGAYDGSTEAFLEDVLELWSSIRVMYADQPDCVDLVATLSEKFKSLYEAEVVPLVQKLKDYRKLECLSAEMKKEIKDIVVSVNKLPKAPWDEGVCKVCGVDKDDDSVLLCDTCDAEYHTYCLNPPLIRIPDGNWYCPSCVIAKRMAQEALESYKLVRRRKGRKYQGELTRASMELTAHLADVMEEKDYWEFSAEERILLLKLLCDELLSSSLVHQHLEQCAEAIIEMQQKLRSLSSEWKNAKMRQEFLTAKLAKVEPSILKEVGEPHNSSYFADQMGCDPQPQEGVGDGVTRDDETSSTAYLNKNQGKSPLETDTQPGESHVNFGESKISSPETISSPGRHELPIADTSPLVTDNLPEKDTSETLLKSVGRNHETHSPNSNAVELPTAHDASSQASQELQACQQDLSATSNEIQNLQQSIRSIESQLLKQSIRRDFLGTDASGRLYWGCCFPDENPRILVDGSISLQKPVQADLIGSKVPSPFLHTVDHGRLRLSPWTYYETETEISELVQWLHDDDLKERDLRESILWWKRLRYGDVQKEKKQAQNLSAPVFATGLETKAAMSMEKRYGPCIKLEMETLKKRGKKTKVAEREKLCRCECLESILPSMIHCLICHKTFASDDEFEDHTESKCIPYSLATEEGKDISDSSKAKESLKSDYLNVKSSAGKDVAEISNVSELDSGLIRYQEEESISPYHFEEICSKFVTKDCNRDLVKEIGLISSNGIPTFLPSSSTHLNDSVLISAKSNKPDGGDSGDQVIFAGPETNVEGLNSESNMSFDRSVTDSHGGPLDKPSGLGFGFSEQKNKKSSGSGLKSCCVVPQAALKRVTGKALPGFRFLKTNLLDMDVALPEEALRPSKSHPNRRRAWRVFVKSSQSIYELVQATIVVEDMIKTEYLKNEWWYWSSLSAAAKISTLSALSVRIFSLDAAIIYDKPITPSNPIDETKPIISLPDQKSQPVSDSQERSSRVRRSGKKRKEPEGSKGGRAKLGTDYKDDDDKDYKDDDDKDYKDDDDKGSLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEGSMAGGLNDIFEAQKIEWHEDTGGS

SEQ ID NO: 851 - DNA, 20 bp, Artificial Sequence
  Synthetic Construct
gagatatagagatgagagag

SEQ ID NO: 852 - DNA, 20 bp, Artificial Sequence
  Synthetic Construct
atagtactagtaatgatttg

SEQ ID NO: 853 - DNA, 83 bp, Artificial Sequence; identical to SEQ ID NO: 400
  Synthetic Construct

SEQ ID NO: 854 - DNA, 7099 bp, Artificial Sequence; identical to SEQ ID NO: 767
  Synthetic Construct

SEQ ID NO: 855 - protein, 1661 aa, Artificial Sequence; identical to SEQ ID NO: 776
  Synthetic Construct

SEQ ID NO: 856 - DNA, 6006 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacacctagggtttatgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccggtcgtacgggcggtggcggagggagcagggctgaccccaagaagaagaggaaggtggaggccagcggttcctccggactcagatctcgagctcaaaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctttttagaaatattgataaagtactaaagagtttgggctttttagaaagcggttctggttctgggggaggaacgctgaagtacgtggaagatgtcacaaatgtcgtgaggagagacgtggagaaatggggcccctttgacctggtgtacggctcgacgcagcccctaggcagctcctgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagggactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttagttccggatctccgaaaaagaaacgcaaagttgactacaaagaccatgacggtgattataaagatcatgacatcgattacaaggatgacgatgacaagtctagaggcggtggcggaggggctccaaagaagaagagaaaggtccgtacgggaggaggatctcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggtggtagcggtggtggtactagtccaaaaacaaggaggagaccgcgaagatcacaacggaaaaggccgcctacgccatggccgtaagtttgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttac

SEQ ID NO: 857 - protein, 1244 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGSLDPGGGGSGSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKGGGRTGRTGGGGGSRADPKKKRKVEASGSSGLRSRAQNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLSSGSPKKKRKVDYKDHDGDYKDHDIDYKDDDDKSRGGGGGAPKKKRKVRTGGGSRTEEYKLILNGKTLKGETTTEAVDAATAEKVFKQYANDNGVDGEWTYDDATKTFTVTEGGGSGGGTSPKTRRRPRRSQRKRPPTPWP

SEQ ID NO: 858 - DNA, 553 bp, Artificial Sequence; identical to SEQ ID NO: 800
  Synthetic Construct

SEQ ID NO: 859 - protein, 543 aa, Artificial Sequence
  Synthetic Construct
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 860 - DNA, 450 bp, Artificial Sequence; identical to SEQ ID NO: 801
  Synthetic Construct

SEQ ID NO: 861 - protein, 908 aa, Mus musculus
MPSSGPGDTSSSSLEREDDRKEGEEQEENRGKEERQEPSATARKVGRPGRKRKHPPVESSDTPKDPAVTTKSQPMAQDSGPSDLLPNGDLEKRSEPQPEEGSPAAGQKGGAPAEGEGTETPPEASRAVENGCCVTKEGRGASAGEGKEQKQTNIESMKMEGSRGRLRGGLGWESSLRQRPMPRLTFQAGDPYYISKRKRDEWLARWKREAEKKAKVIAVMNAVEENQASGESQKVEEASPPAVQQPTDPASPTVATTPEPVGGDAGDKNATKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 862 - protein, 387 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 863 - protein, 12 aa, Artificial Sequence
  Synthetic Construct
AEAAAKEAAAKA

SEQ ID NO: 864 - protein, 16 aa, Artificial Sequence
  Synthetic Construct
SGSETPGTSESATPES

SEQ ID NO: 865 - protein, 15 aa, Artificial Sequence
  Synthetic Construct
SGGGSGGGGSGGGGS

SEQ ID NO: 866 - protein, 18 aa, Artificial Sequence
  Synthetic Construct
GSSGSNGPGGSGGGGSGG

SEQ ID NO: 867 - protein, 9 aa, Artificial Sequence
  Synthetic Construct
SSGPPPGTG

SEQ ID NO: 868 - protein, 12 aa, Artificial Sequence
  Synthetic Construct
AEAAAKEAAAKA

SEQ ID NO: 869 - protein, 16 aa, Artificial Sequence
  Synthetic Construct
SGSETPGTSESATPES

SEQ ID NO: 870 - DNA, 35 bp, Artificial Sequence
  Synthetic Construct
ggaagcttaggccttagaaatctcaaaattccggc

SEQ ID NO: 871 - DNA, 38 bp, Artificial Sequence
  Synthetic Construct
atggcgaaaagcaaaaacccaatcactacttcgtctct

SEQ ID NO: 872 - DNA, 40 bp, Artificial Sequence
  Synthetic Construct
gggtttttgcttttcgccatgttttagagctagaaatagc

SEQ ID NO: 873 - DNA, 33 bp, Artificial Sequence
  Synthetic Construct
ggcaacgcgttctagtaatgccaactttgtaca

SEQ ID NO: 874 - DNA, 20 bp, Artificial Sequence
  Synthetic Construct
attctcgacggaaagatgta

SEQ ID NO: 875 - DNA, 20 bp, Artificial Sequence
  Synthetic Construct
acggaaagatgtatgggctt

SEQ ID NO: 876 - DNA, 20 bp, Artificial Sequence
  Synthetic Construct
ccattggtccaagtgctatt

SEQ ID NO: 877 - DNA, 20 bp, Artificial Sequence
  Synthetic Construct
gcggcgcaagatctgatatt

SEQ ID NO: 878 - DNA, 20 bp, Artificial Sequence
  Synthetic Construct
aaaactaggccatccatgga

SEQ ID NO: 879 - DNA, 20 bp, Artificial Sequence
  Synthetic Construct
gacacacacatacacatacg

SEQ ID NO: 880 - DNA, 20 bp, Artificial Sequence
  Synthetic Construct
gcccttcaattccgtagctt

SEQ ID NO: 881 - DNA, 20 bp, Artificial Sequence
  Synthetic Construct
ggtgggatcttccaaagcta

SEQ ID NO: 882 - DNA, 20 bp, Artificial Sequence
  Synthetic Construct
ggagagaaggatatgatgca

SEQ ID NO: 883 - DNA, 20 bp, Artificial Sequence
  Synthetic Construct
gacaatctctgatgtgaagt

SEQ ID NO: 884 - DNA, 20 bp, Artificial Sequence
  Synthetic Construct
gtactatgtaggcacgactt

SEQ ID NO: 885 - DNA, 20 bp, Artificial Sequence
  Synthetic Construct
gtcaatccgtatcgtagggg

SEQ ID NO: 886 - DNA, 20 bp, Artificial Sequence
  Synthetic Construct
gagcaaagacgctcgtcatg

SEQ ID NO: 887 - DNA, 20 bp, Artificial Sequence
  Synthetic Construct
ggctcgtcatgcggtacacg

SEQ ID NO: 888 - DNA, 20 bp, Artificial Sequence
  Synthetic Construct
gcgacttgaacccaaacctg

SEQ ID NO: 889 - DNA, 20 bp, Artificial Sequence
  Synthetic Construct
gttctcgatgtagtcagtgg

SEQ ID NO: 890 - DNA, 20 bp, Artificial Sequence
  Synthetic Construct
gggtggagcctccctggaga

SEQ ID NO: 891 - DNA, 20 bp, Artificial Sequence
  Synthetic Construct
gatcagctctgaagcggtga

SEQ ID NO: 892 - DNA, 20 bp, Artificial Sequence
  Synthetic Construct
gatggtgtctcctctctgaa

SEQ ID NO: 893 - DNA, 20 bp, Artificial Sequence
  Synthetic Construct
attctcgacggaaagatgta

SEQ ID NO: 894 - DNA, 20 bp, Artificial Sequence
  Synthetic Construct
acggaaagatgtatgggctt

SEQ ID NO: 895 - DNA, 20 bp, Artificial Sequence
  Synthetic Construct
ccattggtccaagtgctatt

SEQ ID NO: 896 - DNA, 20 bp, Artificial Sequence
  Synthetic Construct
gcggcgcaagatctgatatt

SEQ ID NO: 897 - DNA, 20 bp, Artificial Sequence
  Synthetic Construct
aaaactaggccatccatgga

SEQ ID NO: 898 - protein, 1196 aa, Arabidopsis thaliana
MGSEGNMKKSVVTQVSIGGFGESTTAKQLTDYLEDEVGIVWRCRLKTSWTPPGSYPNFEIADTSNIPSIDEYKKVEPHAFVHFAVFESAGRAMDAAGQCNLILDGQPLKVSLGPKNPYSLNQRRRTTVPYKLAGITLEIGTLVSRDDFFVSWRAEGVDFLVDPFDNTCKFCFRKSTAFSFKDAVMHAVINCDYKLELLVRDIQTVRQYKTLHGFVLILQLASSPRVWYRTADDDIYDTVPGDLLDDDDPWIRTTDFTQVGAIGRCHSYRVLISPRYENKLRTALDYFRMRRVQEERVRWPPRIRNEPCFGEPVSDHFFCIHHKEGISFEIMFLVNSVLHRGVFNQFQLTERFFDLLRNQPKDVNIASLKHLCTYKRPVFDAYKRLKLVQEWIQKNPKLLGSHEQSEDISEIRRLVITPTRAYCLPPEVELSNRVLRRYKAVAERFLRVTFMDESMQTINSNVLSYFVAPIVKDLTSSSFSQKTYVFKRVKSILTDGFKLCGRKYSFLAFSANQLRDRSAWFFAEDGKTRVSDIKTWMGKFKDKNVAKCAARMGLCFSSTYATVDVMPHEVDTEVPDIERNGYVFSDGIGTITPDLADEVMEKLKLDVHYSPCAYQIRYAGFKGVVARWPSKSDGIRLALRDSMKKFFSKHTILEICSWTRFQPGFLNRQIITLLSVLGVPDEIFWDMQESMLYKLNRILDDTDVAFEVLTASCAEQGNTAAIMLSAGFKPKTEPHLRGMLSSVRIAQLWGLREKSRIFVTSGRWLMGCLDEAGILEHGQCFIQVSKPSIENCFSKHGSRFKETKTDLEVVKGYVAIAKNPCLHPGDVRILEAVDVPQLHHMYDCLIFPQKGDRPHTNEASGSDLDGDLYFVAWDQKLIPPNRKSYPAMHYDAAEEKSLGRAVNHQDIIDFFARNLANEQLGTICNAHVVHADRSEYGAMDEECLLLAELAATAVDFPKTGKIVSMPFHLKPKLYPDFMGKEDYQTYKSNKILGRLYRRVKEVYDEDAEASSEESTDPSAIPYDAVLEIPGFEDLIPEAWGHKCLYDGQLIGLLGQYKVQKEEEIVTGHIWSMPKYTSKKQGELKERLKHSYNSLKKEFRKVFEETIPDHENLSEEEKNILYEKKASAWYHVTYHPEWVKKSLELQDPDESSHAAMLSFAWIAADYLARIKIRSREMGSIDSAKPVDSLAKFLAQRL

SEQ ID NO: 899 - DNA, 18 bp, Artificial Sequence
  Synthetic Construct
cggaaagatgtatgggct

SEQ ID NO: 900 - DNA, 19 bp, Artificial Sequence
  Synthetic Construct
tggaaaagatgcatgggct

SEQ ID NO: 901 - DNA, 18 bp, Artificial Sequence
  Synthetic Construct
cgaaaagatgtatgggct

SEQ ID NO: 902 - protein, 74 aa, Homo sapiens
GPMYDDPTLPEGWTRKLKQRKSGRSAGKYDVYLINPQGKAFRSKVELIAYFEKVGDTSLDPNDFDFTVTGRGSP

SEQ ID NO: 903 - protein, 72 aa, Homo sapiens
KRMDCALPGWKKEEVIRKSGLSAGKSDVYYFSPPSGKKFRSKPQLARYLGNTVDLSSFDFRTGKMMPSKLQK

SEQ ID NO: 904 - protein, 72 aa, Homo sapiens
DWLDCPALGPGWKRREVFRKSGATCGRSDTYYQSPTGDRIRSKVELTRYLGPACDLTLFDFKQGILCYPAPK

SEQ ID NO: 905 - protein, 66 aa, Arabidopsis thaliana
ATPGDDNWLPPDWRTEIRVRTSGTKAGTVDKFYYEPITGRKFRSKNEVLYYLEHGTPKKKSVKTAE

SEQ ID NO: 906 - protein, 68 aa, Arabidopsis thaliana
PGDNWLPPGWRVEDKIRTSGATAGSVDKYYYEPNTGRKFRSRTEVLYYLEHGTSKRGTKKAENTYFNP

SEQ ID NO: 907 - protein, 65 aa, Arabidopsis thaliana
HSKDFRLPDGWIVEEKPRRSSSHIDRSYIEPGTGNKFRSMAAVERYLISVGNITLDSVSMVHSER

SEQ ID NO: 908 - protein, 75 aa, Arabidopsis thaliana
IDKNISRPPAGWQRLLRIRGEGGTRFADVYYVAPSGKKLRSTVEVQKYLNDNSEYIGEGVKLSQFSFQIPKPLQD

SEQ ID NO: 909 - protein, 49 aa, Arabidopsis thaliana
PPIPTGWSRSVHIRSESTKFADVYYFPPSGERLRSSAEVQSFLDNHPEY

SEQ ID NO: 910 - protein, 70 aa, Arabidopsis thaliana
IDKGLPRTPRGFKRSLILRKDYSKMDAYYITPTGKKLKSRNEIAAFIDANQDYKYALLGDFNFTVPKVME

SEQ ID NO: 911 - protein, 72 aa, Arabidopsis thaliana
IDKPGLPKTPKGFKRSLVLRKDYSKMDTYYFTPTGKKLRSRNEIAAFVEANPEFRNAPLGDFNFTVPKVMED

SEQ ID NO: 912 - protein, 68 aa, Arabidopsis thaliana
PKTPQGLKRVLVVRTNCVKVDVYYESLAPRRKRFKSIKEVATFIEDKEEFKDMTLEEVSFAAPKRLKL

SEQ ID NO: 913 - protein, 51 aa, Arabidopsis thaliana
LPAPASWKKLFYPKRAGTPRKTEIVFVAPTGEEISSRKQLEQYLKAHPGNP

SEQ ID NO: 914 - protein, 48 aa, Arabidopsis thaliana
HGVLEDGWRVEFRQPLNGYQLCAVYCAPNGKTFSSIQEVACYLGLAIN

SEQ ID NO: 915 - protein, 47 aa, Arabidopsis thaliana
LPRGWRLMLYIKRKGSNLLLACRRYISPDGQQFETCKEVSTYLRSLL

What is claimed is:

1. A method for reducing expression of a target nucleic acid in a plant, comprising:
   (a) providing a plant comprising a recombinant nucleic acid, wherein the recombinant nucleic acid encodes a recombinant polypeptide comprising a first amino acid sequence comprising a DNA-binding domain capable of binding a target nucleic acid and a second amino acid sequence comprising a DNA methyltransferase polypeptide selected from the group consisting of an SssI polypeptide comprising an amino acid sequence having at least 90% amino acid identity to SEQ ID NO: 680 and a DRM2 polypeptide comprising an amino acid sequence having at least 90% amino acid identity to SEQ ID NO: 679; and
   (b) growing the plant under conditions whereby the recombinant polypeptide encoded by the recombinant nucleic acid is expressed and binds to the target nucleic acid, thereby reducing expression of the target nucleic acid, wherein the target nucleic acid exhibits a specific increase in methylation over 5 to 3,000 nucleotides 5' and/or 3' to the target nucleotide sequence in the nucleic acid as compared to a corresponding control nucleic acid.

2. The method of claim 1, wherein the DNA-binding domain comprises a zinc finger domain.

3. The method of claim 1, wherein the DNA methyltransferase polypeptide is an SssI polypeptide, and wherein said polypeptide comprises an amino acid sequence having at least 95% amino acid identity to SEQ ID NO: 680.

4. The method of claim 1, wherein the DNA methyltransferase polypeptide is a DRM2 polypeptide, and wherein said polypeptide comprises an amino acid sequence having at least 95% amino acid identity to SEQ ID NO: 679.

5. The method of claim 1, wherein the target nucleic acid is an endogenous nucleic acid.

6. The method of claim 1, wherein the target nucleic acid is a heterologous nucleic acid.

7. The method of claim 1, wherein expression of the target nucleic acid is silenced.

8. A plant cell comprising a recombinant polypeptide comprising a first amino acid sequence comprising a DNA-binding domain and a second amino acid sequence comprising a DNA methyltransferase polypeptide selected from the group consisting of an SssI polypeptide comprising an amino acid sequence having at least 90% amino acid identity to SEQ ID NO: 680 and a DRM2 polypeptide comprising an amino acid sequence having at least 90% amino acid identity to SEQ ID NO: 679, wherein the plant cell comprises a nucleic acid with reduced expression and a specific increase in methylation over 5 to 3,000 nucleotides 5' and/or 3' to a target nucleotide sequence in the nucleic acid as compared to a corresponding control nucleic acid.

9. A recombinant plant comprising the plant cell of claim 8.

* * * * *